(12) United States Patent
Crine et al.

(10) Patent No.: US 9,266,939 B2
(45) Date of Patent: Feb. 23, 2016

(54) COMPOSITIONS COMPRISING NATRIURETIC PEPTIDES AND METHODS OF USE THEREOF

(75) Inventors: Philippe Crine, Outremont (CA); Simon Joubert, Montreal (CA); Marie Parat, Montreal (CA)

(73) Assignee: Alexion Pharmaceuticals, Inc., Cheshire, CT (US)

( * ) Notice: Subject to any disclaimer, the term of this patent is extended or adjusted under 35 U.S.C. 154(b) by 0 days.

(21) Appl. No.: 13/336,651

(22) Filed: Dec. 23, 2011

(65) Prior Publication Data

US 2012/0164142 A1  Jun. 28, 2012

Related U.S. Application Data

(60) Provisional application No. 61/427,365, filed on Dec. 27, 2010, provisional application No. 61/524,155, filed on Aug. 16, 2011.

(51) Int. Cl.

| C07K 1/00 | (2006.01) |
|---|---|
| C07K 16/00 | (2006.01) |
| A61K 38/12 | (2006.01) |
| C07K 14/58 | (2006.01) |
| A61K 31/7088 | (2006.01) |
| A61K 38/22 | (2006.01) |

(52) U.S. Cl.
CPC .............. *C07K 14/58* (2013.01); *A61K 31/7088* (2013.01); *A61K 38/2242* (2013.01); *C07K 2319/22* (2013.01); *C07K 2319/30* (2013.01); *C07K 2319/31* (2013.01)

(58) Field of Classification Search
None
See application file for complete search history.

(56) References Cited

U.S. PATENT DOCUMENTS

| 5,336,759 | A | 8/1994 | Matsuo et al. |
|---|---|---|---|
| 5,338,830 | A | 8/1994 | Matsuo et al. |
| 5,340,920 | A | 8/1994 | Matsuo et al. |
| 5,352,770 | A | 10/1994 | Matsuo |
| 5,428,130 | A | 6/1995 | Capon et al. |
| 5,434,133 | A | 7/1995 | Tanaka et al. |
| 5,583,108 | A | 12/1996 | Wei et al. |
| 5,665,704 | A | 9/1997 | Lowe et al. |
| 5,714,147 | A | 2/1998 | Capon et al. |
| 5,767,239 | A | 6/1998 | Immer et al. |
| 5,846,932 | A | 12/1998 | Lowe et al. |
| 5,948,761 | A | 9/1999 | Seilhamer et al. |
| 5,973,134 | A | 10/1999 | Matsuo et al. |
| 6,020,168 | A | 2/2000 | Matsuo et al. |
| 6,028,055 | A | 2/2000 | Lowe et al. |
| 6,034,231 | A | 3/2000 | Tanaka et al. |
| 6,290,952 | B1 | 9/2001 | Poelstra et al. |
| 6,406,697 | B1 | 6/2002 | Capon et al. |
| 6,407,211 | B1 | 6/2002 | Burnett, Jr. et al. |
| 6,420,384 | B2 | 7/2002 | Weigele et al. |
| 6,436,386 | B1 | 8/2002 | Roberts et al. |
| 6,455,495 | B1 | 9/2002 | Orgel et al. |
| 6,458,579 | B2 | 10/2002 | Hopwood et al. |
| 6,525,022 | B1 | 2/2003 | Lowe et al. |
| 6,541,610 | B1 * | 4/2003 | Smith .......................... 530/387.1 |
| 6,743,425 | B2 | 6/2004 | Nakao |
| 6,790,649 | B1 | 9/2004 | Crine et al. |
| 6,818,619 | B2 | 11/2004 | Burnett, Jr. et al. |
| 6,830,885 | B1 | 12/2004 | Lanctot et al. |
| 6,849,714 | B1 | 2/2005 | Bridon et al. |
| 6,887,470 | B1 | 5/2005 | Bridon et al. |
| 6,905,689 | B2 | 6/2005 | Schneidinger et al. |
| 6,946,484 | B2 | 9/2005 | Adams et al. |
| 7,026,293 | B2 | 4/2006 | Kitakaze |
| 7,033,997 | B2 | 4/2006 | Forssmann et al. |
| 7,070,974 | B1 | 7/2006 | Desgroseillers et al. |
| 7,105,539 | B2 | 9/2006 | Gravel et al. |
| 7,179,903 | B2 | 2/2007 | McArthur et al. |
| 7,256,253 | B2 | 8/2007 | Bridon et al. |
| 7,271,149 | B2 | 9/2007 | Glaesner et al. |
| 7,276,481 | B2 | 10/2007 | Golembo et al. |

(Continued)

FOREIGN PATENT DOCUMENTS

| EP | 0478797 B1 | 4/1995 |
|---|---|---|
| EP | 0769554 A2 | 4/1997 |
| EP | 0466174 B1 | 6/1997 |
| EP | 0475394 B1 | 6/1997 |
| EP | 0466175 B1 | 1/1998 |
| EP | 0477971 B1 | 1/1998 |
| EP | 0475290 B1 | 12/1998 |
| EP | 0475291 B1 | 12/1998 |
| EP | 0497368 B1 | 6/2002 |
| EP | 1492567 A0 | 1/2005 |

(Continued)

OTHER PUBLICATIONS

Mayer. 2009. Immunology Section of Microbiology and Immunology On-line.*

(Continued)

*Primary Examiner* — Shulamith H Shafer
(74) *Attorney, Agent, or Firm* — Clark & Elbing LLP; Kristina Bieker-Brady; Todd Armstrong

(57) ABSTRACT

The present invention provides methods, compositions, and kits for the treatment of disorders associated with overactivation of FGFR3, such as achondroplasia; bone or cartilage disorders; or vascular smooth muscle disorders, or for the elongation of bone. In some embodiments, the present invention provides polypeptides having a natriuretic peptide fused to an Fc domain of an immunoglobulin. Such polypeptides can be administered to subjects, e.g., subcutaneously, to treat a disorder associated with overactivation of FGFR3, a bone or cartilage disorder, or a vascular smooth muscle disorder, or to elongate bone. The invention also features nucleic acid molecules encoding such polypeptides and the use of the nucleic acid molecules for treating disorders associated with overactivation of FGFR3, bone or cartilage disorders, or vascular smooth muscle disorders, or for elongating bone.

45 Claims, 118 Drawing Sheets

(56) References Cited

U.S. PATENT DOCUMENTS

| | | | |
|---|---|---|---|
| 7,341,838 B2 | 3/2008 | Buechler et al. | |
| 7,365,091 B2 | 4/2008 | Gravel et al. | |
| 7,384,917 B2 | 6/2008 | Burnett, Jr. et al. | |
| 7,399,466 B2 | 7/2008 | Boileau | |
| 7,414,107 B2 | 8/2008 | Larsen | |
| 7,425,531 B2 | 9/2008 | Lanctot et al. | |
| 7,427,498 B2 | 9/2008 | Crine et al. | |
| 7,470,668 B2 | 12/2008 | Lanctot et al. | |
| 7,488,713 B2 | 2/2009 | Vesely | |
| 7,527,939 B2 | 5/2009 | Davey et al. | |
| 7,563,769 B2 | 7/2009 | Bogin et al. | |
| 7,625,564 B2 | 12/2009 | Wang et al. | |
| 7,642,243 B2 | 1/2010 | Nakao et al. | |
| 7,648,962 B2 | 1/2010 | James et al. | |
| 7,662,773 B2 | 2/2010 | James et al. | |
| 7,678,391 B2 | 3/2010 | Graham et al. | |
| 7,732,406 B2 | 6/2010 | Mitrovic et al. | |
| 7,736,653 B2 | 6/2010 | Kim et al. | |
| 7,754,852 B2 | 7/2010 | Burnett, Jr. et al. | |
| 7,763,712 B2 | 7/2010 | Crine et al. | |
| 7,803,769 B2 | 9/2010 | Sullivan et al. | |
| 7,803,901 B2 | 9/2010 | Burnett, Jr. et al. | |
| 7,825,092 B2 | 11/2010 | Vesely | |
| 7,846,900 B2 | 12/2010 | Vesely | |
| 7,858,560 B2 | 12/2010 | Koster et al. | |
| 7,919,591 B2 * | 4/2011 | Sheffer et al. | 530/363 |
| 7,943,126 B2 | 5/2011 | Tomatsu et al. | |
| 7,960,529 B2 | 6/2011 | Crine et al. | |
| 8,058,242 B2 | 11/2011 | Alewood et al. | |
| 2002/0183276 A1 | 12/2002 | Millan et al. | |
| 2003/0158132 A1 | 8/2003 | Kovesdi | |
| 2004/0023916 A1 | 2/2004 | Millan et al. | |
| 2004/0077537 A1 | 4/2004 | Schreiner | |
| 2004/0234518 A1 | 11/2004 | Crine et al. | |
| 2005/0113286 A1 | 5/2005 | Schreiner et al. | |
| 2005/0142217 A1 | 6/2005 | Adams et al. | |
| 2005/0202442 A1 | 9/2005 | Morris et al. | |
| 2005/0244904 A1 | 11/2005 | Ng | |
| 2005/0276796 A1 | 12/2005 | Tomatsu et al. | |
| 2006/0014687 A1 | 1/2006 | Crine et al. | |
| 2006/0019890 A1 | 1/2006 | Kapoun et al. | |
| 2006/0074009 A1 | 4/2006 | James et al. | |
| 2006/0110359 A1 | 5/2006 | Sanchez-Ramos et al. | |
| 2006/0172929 A1 | 8/2006 | Rappold-Hoerbrand et al. | |
| 2006/0228710 A1 | 10/2006 | Morris et al. | |
| 2007/0041972 A1 | 2/2007 | Rother et al. | |
| 2007/0042957 A1 | 2/2007 | Burnett, Jr. et al. | |
| 2007/0081984 A1 | 4/2007 | Tomatsu et al. | |
| 2007/0081986 A1 | 4/2007 | Tomatsu et al. | |
| 2007/0197434 A1 | 8/2007 | Nakao et al. | |
| 2007/0281887 A1 | 12/2007 | Pan | |
| 2007/0292966 A1 | 12/2007 | Prickett et al. | |
| 2007/0293418 A1 | 12/2007 | Larsen | |
| 2008/0032933 A1 | 2/2008 | Burnett, Jr. et al. | |
| 2008/0081768 A1 | 4/2008 | Watt et al. | |
| 2008/0085862 A1 | 4/2008 | Kim et al. | |
| 2008/0113411 A1 | 5/2008 | Sheffer et al. | |
| 2008/0113412 A1 | 5/2008 | Sheffer et al. | |
| 2008/0125574 A1 | 5/2008 | Sheffer et al. | |
| 2008/0153747 A1 | 6/2008 | Alewood et al. | |
| 2008/0161243 A1 | 7/2008 | Rosen et al. | |
| 2008/0181903 A1 | 7/2008 | Bhaskar et al. | |
| 2008/0182299 A1 | 7/2008 | Colocaru et al. | |
| 2008/0194481 A1 | 8/2008 | Rosen et al. | |
| 2008/0194682 A1 | 8/2008 | Golembo et al. | |
| 2008/0227713 A1 | 9/2008 | Protter | |
| 2008/0293632 A1 | 11/2008 | Rappold-Hoerbrand et al. | |
| 2008/0312142 A1 | 12/2008 | Nakao et al. | |
| 2009/0011997 A1 | 1/2009 | Peri et al. | |
| 2009/0053192 A1 | 2/2009 | Millan et al. | |
| 2009/0069243 A1 | 3/2009 | Burnett, Jr. et al. | |
| 2009/0092582 A1 | 4/2009 | Bogin et al. | |
| 2009/0142347 A1 | 6/2009 | Millan | |
| 2009/0170756 A1 | 7/2009 | Burnett, Jr. et al. | |
| 2009/0221803 A1 | 9/2009 | Dall'Acqua et al. | |
| 2009/0238814 A1 | 9/2009 | Tomatsu et al. | |
| 2009/0240031 A1 | 9/2009 | Immer et al. | |
| 2009/0247462 A1 | 10/2009 | Bogin et al. | |
| 2009/0252729 A1 | 10/2009 | Farrington et al. | |
| 2009/0275506 A1 | 11/2009 | Bakis et al. | |
| 2009/0325195 A1 | 12/2009 | Davey et al. | |
| 2010/0008979 A1 | 1/2010 | Tomatsu et al. | |
| 2010/0055150 A1 | 3/2010 | Golembo et al. | |
| 2010/0160212 A1 | 6/2010 | Sheffer et al. | |
| 2010/0168443 A1 | 7/2010 | Geysen | |
| 2010/0184680 A1 | 7/2010 | Bevec | |
| 2010/0197574 A1 | 8/2010 | Chen et al. | |
| 2010/0204094 A1 | 8/2010 | Simari et al. | |
| 2010/0204109 A1 | 8/2010 | Bevec | |
| 2010/0204446 A1 | 8/2010 | Forssmann | |
| 2010/0209958 A1 | 8/2010 | Nakao et al. | |
| 2010/0216714 A1 | 8/2010 | James et al. | |
| 2010/0221234 A1 | 9/2010 | Crine et al. | |
| 2010/0240125 A1 | 9/2010 | Crine et al. | |
| 2010/0249017 A1 | 9/2010 | Bevec et al. | |
| 2010/0260706 A1 | 10/2010 | Bogin et al. | |
| 2010/0261248 A1 | 10/2010 | Kim et al. | |
| 2010/0297021 A1 | 11/2010 | Wendt et al. | |
| 2010/0297119 A1 | 11/2010 | Crine et al. | |
| 2010/0305031 A1 | 12/2010 | Wakabayashi et al. | |
| 2010/0305051 A1 | 12/2010 | Burnett, Jr. et al. | |
| 2010/0310561 A1 * | 12/2010 | Canada | C12N 15/62 424/134.1 |
| 2010/0311660 A1 | 12/2010 | Simari et al. | |
| 2010/0317600 A1 | 12/2010 | Immer et al. | |
| 2010/0331256 A1 | 12/2010 | Wendt et al. | |
| 2011/0152194 A1 | 6/2011 | Burnett, Jr. et al. | |
| 2011/0250187 A1 | 10/2011 | Tomatsu et al. | |
| 2011/0269684 A1 | 11/2011 | Burnett, Jr. et al. | |

FOREIGN PATENT DOCUMENTS

| | | |
|---|---|---|
| EP | 1502604 A1 | 2/2005 |
| EP | 1623994 A2 | 2/2006 |
| EP | 1759001 | 3/2007 |
| EP | 1759710 A1 | 3/2007 |
| EP | 0771875 B1 | 2/2008 |
| EP | 2158319 | 3/2010 |
| JP | 8070875 | 3/1996 |
| JP | 2000-327583 A | 11/2000 |
| JP | 2002-541776 A2 | 12/2002 |
| JP | 2007-511209 A | 5/2007 |
| JP | 2010-501026 A | 1/2010 |
| JP | 2010-530222 A | 9/2010 |
| WO | WO-92/20371 A1 | 11/1992 |
| WO | WO-9420534 A1 | 9/1994 |
| WO | WO-9513296 A1 | 5/1995 |
| WO | WO-9533769 A1 | 12/1995 |
| WO | WO-9817690 A1 | 4/1998 |
| WO | WO-98/35703 A2 | 8/1998 |
| WO | WO-9946283 A9 | 11/1999 |
| WO | WO-00/18954 A2 | 4/2000 |
| WO | WO-00/50580 A2 | 8/2000 |
| WO | WO-0053755 A2 | 9/2000 |
| WO | WO-00/64486 A2 | 11/2000 |
| WO | WO-0069900 A2 | 11/2000 |
| WO | WO-01/36620 A2 | 5/2001 |
| WO | WO-0144284 A2 | 6/2001 |
| WO | WO-0180890 A2 | 11/2001 |
| WO | WO-02/15918 A2 | 2/2002 |
| WO | WO-02/47871 A1 | 6/2002 |
| WO | 02/067639 A1 | 8/2002 |
| WO | WO-02/067639 A1 | 8/2002 |
| WO | WO-02/068579 A2 | 9/2002 |
| WO | WO-02074234 A2 | 9/2002 |
| WO | WO-03074082 A1 | 9/2003 |
| WO | WO-03/079979 A2 | 10/2003 |
| WO | WO-03092581 A2 | 11/2003 |
| WO | WO-03/094835 A2 | 11/2003 |
| WO | WO-2004011498 A2 | 2/2004 |
| WO | WO-2004022579 A2 | 3/2004 |
| WO | WO-2004046194 A2 | 6/2004 |
| WO | WO-2004047871 A2 | 6/2004 |
| WO | WO-2004062555 A2 | 7/2004 |

(56) References Cited

FOREIGN PATENT DOCUMENTS

| WO | WO-2004074320 A2 | 9/2004 |
| --- | --- | --- |
| WO | WO-200409446 A2 | 11/2004 |
| WO | WO-2005000095 A2 | 1/2005 |
| WO | WO-2005007809 A2 | 1/2005 |
| WO | 2005/042034 A1 | 5/2005 |
| WO | WO-2005047337 A1 | 5/2005 |
| WO | WO-2005070446 A1 | 8/2005 |
| WO | WO-2005072055 A2 | 8/2005 |
| WO | WO-2005/098490 A1 | 10/2005 |
| WO | WO-2005094890 A1 | 10/2005 |
| WO | WO-2005/103263 A1 | 11/2005 |
| WO | WO-2006005140 A2 | 1/2006 |
| WO | WO-2006/039480 A2 | 4/2006 |
| WO | WO-2006026663 A9 | 5/2006 |
| WO | WO-2006/060641 A2 | 6/2006 |
| WO | WO-2006110743 A1 | 10/2006 |
| WO | WO-2006116260 A2 | 11/2006 |
| WO | WO-2007041645 A2 | 4/2007 |
| WO | WO-2007097923 A2 | 8/2007 |
| WO | WO-2008021872 A1 | 2/2008 |
| WO | WO-2008030558 A2 | 3/2008 |
| WO | WO-2008031045 A2 | 3/2008 |
| WO | 2008/053362 A2 | 5/2008 |
| WO | WO-2008058016 A2 | 5/2008 |
| WO | 2008/088422 A2 | 7/2008 |
| WO | WO-2008079995 A2 | 7/2008 |
| WO | WO-2008109903 A1 | 9/2008 |
| WO | WO-2008/138131 A1 | 11/2008 |
| WO | WO-2008136611 A1 | 11/2008 |
| WO | WO-2008154226 A1 | 12/2008 |
| WO | WO-2009006520 A1 | 1/2009 |
| WO | WO-2009015011 A1 | 1/2009 |
| WO | WO-2009023270 A2 | 2/2009 |
| WO | WO-2009006732 A9 | 3/2009 |
| WO | WO-2009033680 A2 | 3/2009 |
| WO | WO-2009033724 A1 | 3/2009 |
| WO | WO-2009033796 A1 | 3/2009 |
| WO | WO-2009033807 A2 | 3/2009 |
| WO | WO-2009034134 A2 | 3/2009 |
| WO | WO-2009036448 A2 | 3/2009 |
| WO | WO-2009040030 A1 | 4/2009 |
| WO | WO-2009040031 A2 | 4/2009 |
| WO | WO-2009040083 A2 | 4/2009 |
| WO | WO-2009046861 A1 | 4/2009 |
| WO | WO-2009058322 A1 | 5/2009 |
| WO | WO-2009067639 A2 | 5/2009 |
| WO | WO-2009086126 A2 | 7/2009 |
| WO | WO-2009090553 A2 | 7/2009 |
| WO | WO-2009142307 A1 | 11/2009 |
| WO | WO-2009156481 A1 | 12/2009 |
| WO | WO-2010002583 A2 | 1/2010 |
| WO | WO-2010011096 A2 | 1/2010 |
| WO | WO-2009149161 A9 | 4/2010 |
| WO | WO-2010048308 A2 | 4/2010 |
| WO | WO-2010078325 A2 | 7/2010 |
| WO | WO-2010082804 A2 | 7/2010 |
| WO | WO-2010117760 A2 | 10/2010 |
| WO | WO-2010129655 A2 | 11/2010 |
| WO | WO-2010135541 A2 | 11/2010 |
| WO | WO-2011134084 A1 | 11/2011 |
| WO | WO-2012/099851 A2 | 7/2012 |
| WO | WO-2013/058833 A1 | 4/2013 |
| WO | WO-2013/059491 A1 | 4/2013 |

OTHER PUBLICATIONS

Bocciardi et al., "Overexpression of the C-type natriuretic peptide (CNP) is associated with overgrowth and bone anomalies in an individual with balanced t(2;7) translocation," *Hum. Mutat.* 28:724-731, 2007.

Brenner et al., "Diverse biological actions of atrial natriuretic peptide," *Physiol. Rev.* 70:665-699, 1990.

Chen et al., "Gly369Cys mutation in mouse FGFR3 causes achondroplasia by affecting both chondrogenesis and osteogenesis," *J. Clin. Invest.* 104:1517-1525, 1999.

Choe et al., "Substrate profiling of cysteine proteases using a combinatorial peptide library identifies functionally unique specificities," *J. Biol. Chem.* 281:12824-12832, 2006.

Chusho et al., "Dwarfism and early death in mice lacking C-type natriuretic peptide," *Proc. Natl Acad. Sci .U.S.A.* 98:4016-4021, 2001.

Daggubati et al., "Adrenomedullin, endothelin, neuropeptide Y, atrial, brain, and C-natriuretic prohormone peptides compared as early heart failure indicators," *Cardiovasc. Res.* 36:246-255, 1997.

de Plater et al., "The natriuretic peptide (ovCNP-39) from platypus (Ornithorhynchus anatinus) venom relaxes the isolated rat uterus and promotes oedema and mast cell histamine release," *Toxicon* 847-857, 1998.

Farnum et al., "In vivo delivery of fluoresceinated dextrans to the murine growth plate: Imaging of three vascular routes by multiphoton microscopy," *Anat. Rec. A Discov. Mol. Cell Evol. Biol.* 288:91-103, 2006.

Furuya et al., "Structural requirements of C-type natriuretic peptide for elevation of cyclic GMP in cultured vascular smooth muscle cells," Biochem. Biophys. Res. Commun. 183:964-969, 1992.

Hagiwara et al., "Autocrine regulation of rat chondrocyte proliferation by natriuretic peptide C and its receptor, natriuretic peptide receptor-B," *J. Biol. Chem.* 269:10729-10733, 1994.

Hagiwara et al., "cGMP produced in response to ANP and CNP regulates proliferation and differentiation of osteoblastic cells," *Am. J. Physiol.* 270:C1311-C1318, 1996.

Horton et al., "Achondroplasia," *Lancet* 370:162-172, 2007.

Ikezawa, "Glycosylphosphatidylinositol (GPI)—anchored proteins," *Biol. Pharm. Bull.* 25: 409-417, 2002.

Inoue et al., "Four functionally distinct C-type natriuretic peptides found in fish reveal evolutionary history of the natriuretic peptide system," *Proc. Natl Acad. Sci. U.S.A.* 100:10079-10084, 2003.

International Search Report from International Application No. PCT/CA2011/050807, dated Apr. 13, 2012 (date of mailing of report) (8 pages).

Invitation to Pay Additional Fees for International Application No. PCT/CA2011/050807, dated Feb. 13, 2012 (date of mailing of report) (2 pages).

Kalra et al., "The role of C-type natriuretic peptide in cardiovascular medicine," *Eur. Heart J.* 22:997-1007, 2001.

Kostenuik et al., "Infrequent delivery of a long-acting PTH-Fc fusion protein has potent anabolic effects on cortical and cancellous bone," *J. Bone Miner. Res.* 22: 1534-1547, 2007.

Lo et al., "High level expression and secretion of Fc-X fusion proteins in mammalian cells," *Protein Eng.* 11: 495-500, 1998.

Mericq et al., "Regulation of fetal rat bone growth by C-type natriuretic peptide and cGMP," *Pediatr. Res.* 47:189-193, 2000.

Miyazawa et al., "Cyclic GMP-dependent protein kinase II plays a critical role in C-type natriuretic peptide-mediated endochondral ossification," *Endocrinology* 143:3604-3610, 2002.

Nakao et al., "The pharmacokinetics of alpha-human atrial natriuretic polypeptide in healthy subjects," *Eur. J. Clin. Pharmacol.* 31:101-103, 1986.

Pfeifer et al., "Intestinal secretory defects and dwarfism in mice lacking cGMP-dependent protein kinase II," *Science* 274:2082-2086, 1996.

Potter et al., "Natriuretic peptides, their receptors, and cyclic guanosine monophosphate-dependent signaling functions," *Endocr. Rev.* 27:47-72, 2006.

Shukla et al., "RNA interference and inhibition of MEK-ERK signaling prevent abnormal skeletal phenotypes in a mouse model of craniosynostosis," *Nat Genet.* 39: 1145-1150, 2007.

Suda et al., "C-type natriuretic peptide as an autocrine/paracrine regulator of osteoblast. Evidence for possible presence of bone natriuretic peptide system," *Biochem. Biophys. Res. Commun.* 223:1-6, 1996.

Takano et al., "Molecular evolution of shark C-type natriuretic peptides," *Zoolog. Sci.* 11: 451-454, 1994.

Tamura et al., "Critical roles of the guanylyl cyclase B receptor in endochondral ossification and development of female reproductive organs," *Proc. Natl Acad. Sci. U.S.A.* 101:17300-17305, 2004.

(56) References Cited

OTHER PUBLICATIONS

Teixeira et al., "Nitric oxide, C-type natriuretic peptide and cGMP as regulators of endochondral ossification," *Dev. Biol.* 319:171-178, 2008.

Tsuji et al., "A loss-of-function mutation in natriuretic peptide receptor 2 (Npr2) gene is responsible for disproportionate dwarfism in cn/cn mouse," *J. Biol. Chem.* 280:14288-14292, 2005.

Williams et al., "Solute transport in growth plate cartilage: In vitro and in vivo," *Biophys. J.* 93:1039-1050, 2007.

Written Opinion from International Application No. PCT/CA2011/050807, mailed on Apr. 13, 2012 (9 pages).

Yamamoto et al., "Prolonged survival and phenotypic correction of Akp2(−/−) hypophosphatasia mice by lentiviral gene therapy," *J. Bone. Miner. Res.* 26: 135-142, 2011.

Yamamoto et al., "Long term phenotypic correction of severe infantile hypophosphatasia in a mouse model by neonatal injection of lentiviral vector," *Mol. Therapy* 17: S67-S68, 2009.

Yasoda et al., "Natriuretic peptide regulation of endochondral ossification. Evidence for possible roles of the C-type natriuretic peptide/guanylyl cyclase-B pathway," *J. Biol. Chem.* 273:11695-11700; 1998.

Yasoda et al., "Overexpression of CNP in chondrocytes rescues achondroplasia through a MAPK-dependent pathway," *Nat. Med.* 10:80-86, 2004.

Yasoda et al., "Systemic administration of C-type natriuretic peptide as a novel therapeutic strategy for skeletal dysplasias," *Endocrinology* 150:3138-3144, 2009.

Yoder et al., "Reduced ability of C-type natriuretic peptide (CNP) to activate natriuretic peptide receptor B (NPR-B) causes dwarfism in Ibab −/− mice," *Peptides* 29:1575-1581, 2008.

Ali et al., "Isolation and characterization of calcifying matrix vesicles from epiphyseal cartilage," Proc Natl Acad Sci USA. 67(3):1513-1520 (1970).

Anderson et al., "Pyrophosphate stimulation of calcium uptake into cultured embryonic bones. Fine structure of matrix vesicles and their role in calcification," Dev Biol. 34:211-227 (1973).

Anderson et al., "Impaired calcification around matrix vesicles of growth plate and bone in alkaline phosphatase-deficient mice," Am J Pathol. 164(3):841-847 (2004).

Anderson et al., "Matrix vesicles in osteomalacic hypophosphatasia bone contain apatite-like mineral crystals," Am J Pathol. 151(6):1555-1561 (1997).

Anderson et al., "Sustained osteomalacia of long bones despite major improvement in other hypophosphatasia-related mineral deficits in tissue nonspecific alkaline phosphatase/nucleotide pyrophosphatase phosphodiesterase 1 double-deficient mice," Am J Pathol. 166(6):1711-1720 (2005).

Anderson et al., "The role of matrix vesicles in growth plate development and biomineralization," Front Biosci. 10:822-837 (2005).

Beertsen et al., "Root development in mice lacking functional tissue non-specific alkaline phosphatase gene: Inhibition of acellular cementum formation," J Dent Res. 78(6):1221-1229 (1999).

Bernard, "Ultrastructural localization of alkaline phosphatase in initial intramembranous osteogenesis," Clin Orthop Relat Res. 135:218-225 (1978).

Cameron et al., "Minireview: natriuretic peptides during development of the fetal heart and circulation," Endocrinology. 144(6):2191-2194 (2003).

Clemens et al., "Pharmacokinetics and biological actions of subcutaneously administered human brain natriuretic peptide," J Pharmacol Exp Ther. 287(1):67-71 (1998).

Di Mauro et al., "Kinetic characterization of hypophosphatasia mutations with physiological substrates," J Bone Miner Res. 17:1383-1391 (2002).

Farley et al., "Effects of tunicamycin, mannosamine, and other inhibitors of glycoprotein processing on skeletal alkaline phosphatase in human osteoblast-like cells," Calcif Tissue Int. 76:63-74 (2005).

Fedde et al., "Alkaline phosphatase knock-out mice recapitulate the metabolic and skeletal defects of infantile hypophosphatasia," J Bone Miner Res. 14(12):2015-2026 (1999).

Greenberg et al., "A homoallelic $Gly^{317} \to Asp$ mutation in *ALPL* causes the perinatal (lethal) form of hypophosphatasia in Canadian mennonites," Genomics. 17:215-217 (1993).

Harmey et al., "Concerted regulation of inorganic pyrophosphate and osteopontin by *Akp2*, *Enpp1*, and *Ank*," Am J Pathol. 164(4):1199-1209 (2004).

Harmey et al., "Elevated skeletal osteopontin levels contribute to the hypophosphatasia phenotype in $Akp^{-/-}$ mice," J Bone Miner Res. 21(9):1377-1386 (2006).

Hawrylak et al., "The solubilization of tetrameric alkaline phosphatase from human liver and its conversion into various forms by phosphatidylinositol phospholipase C or proteolysis," J Biol Chem. 263(28):14368-14373 (1988).

Henthorn et al., "Missense mutations of the tissue non-specific alkaline phosphatase gene in hypophosphatasia," Clin Chem. 389(12):2501-2505 (1992).

Henthorn et al., "Different missense mutations at the tissue-nonspecific alkaline phosphatase gene locus in autosomal recessively inherited forms of mild and severe hypophosphatasia," Proc Natl Acad Sci USA. 89:9924-9928 (1992).

Hessle et al., "Tissue-nonspecific alkaline phosphatase and plasma cell membrane glucoprotein-1 are central antagonistic regulators of bone mineralization," Proc Natl Acad Sci USA. 99(14): 9445-9449 (2002).

Jansonius, "Structure, evolution and action of vitamin $B_6$-dependent enzymes," Curr Opin Struct Biol. 8:759-769 (1998).

Johnson et al., "Matrix vesicle plasma cell membrane glycoprotein-1 regulates mineralization by murine osteoblastic MC3T3 cells," J Bone Miner Res. 14(6):883-892 (1999).

Mahmood et al., "Selection of the first-time dose in humans: comparison of different approaches based on interspecies scaling of clearance," J Clin Pharmacol. 43:692-697 (2003).

Meyer, "Can biological calcification occur in the presence of pyrophosphate?" Arch Biochem Biophys. 231:1-8 (1984).

Milián, Mammalian alkaline phosphatases. *Biology to Applications in Medicine and Biotechnology*. Wiley-VCH Verlag, 107-185 (2006).

Morris et al., "Immunolocalization of alkaline phosphatase in osteoblasts and matrix vesicles of human fetal bone," Bone Miner. 19:287-298 (1992).

Murshed et al., "Unique coexpression in osteoblasts of broadly expressed genes accounts for the spatial restriction of ECM mineralization to bone," Genes Dev. 19:1093-1104 (2005).

Narisawa et al., "Abnormal vitamin B6 metabolism in alkaline phosphatase knock-out mice causes multiple abnormalities, but not the impaired bone mineralization," J Pathol. 193:125-133 (2001).

Narisawa et al., "Inactivation of two mouse alkaline phosphatase genes and establishment of a model of infantile hypophosphatasia," Dev Dyn. 208:432-446 (1997).

Nasu et al., "Aberrant interchain disulfide bridge of tissue-nonspecific alkaline phosphatase with an Arg433 → Cys substitution associated with severe hypophosphatasia," FEBS Journal. 273:5612-5624 (2006).

NCBI Protein Database Accession No. AAC33858. Retrieved on Apr. 16, 2013 (1 page).

NCBI Protein Database Accession No. AAF64516. Retrieved on Apr. 16, 2013 (2 pages).

NCBI Protein Database Accession No. AAH21289. Retrieved on Apr. 16, 2013 (2 pages).

NCBI Protein Database Accession No. AAH66116. Retrieved on Apr. 16, 2013 (2 pages).

NCBI Protein Database Accession No. AAH90861. Retrieved on Apr. 16, 2013 (2 pages).

NCBI Protein Database Accession No. AAI10910. Retrieved on Apr. 16, 2013 (2 pages).

NCBI Protein Database Accession No. AAI18209. Retrieved on Apr. 17, 2013 (2 pages).

NCBI Protein Database Accession No. AAI26166. Retrieved on Apr. 16, 2013 (2 pages).

NCBI Protein Database Accession No. AAN64273. Retrieved on Apr. 16, 2013 (1 page).

(56) References Cited

OTHER PUBLICATIONS

NCBI Protein Database Accession No. NP_001623. Retrieved on Apr. 16, 2013 (3 pages).
NCBI Protein Database Accession No. NP_001622. Retrieved on Apr. 16, 2013 (3 pages).
NCBI Protein Database Accession No. NP_000469. Retrieved on Apr. 16, 2013 (2 pages).
NCBI Protein Database Accession No. NP_001036028. Retrieved on Apr. 16, 2013 (2 pages).
NCBI Protein Database Accession No. NP_031457. Retrieved on Apr. 16, 2013 (3 pages).
NCBI Protein Database Accession No. NP_037191. Retrieved on Apr. 16, 2013 (3 pages).
NCBI Protein Database Accession No. NP_112603. Retrieved on Apr. 16, 2013 (3 pages).
NCBI Protein Database Accession No. NP_776412. Retrieved on Apr. 17, 2013 (2 pages).
NCBI Protein Database Accession No. NP_789828. Retrieved on Apr. 16, 2013 (3 pages).
NCBI Protein Database Accession No. P05186. Retrieved on Apr. 16, 2013 (19 pages).
NCBI Protein Database Accession No. P05187. Retrieved on Apr. 16, 2013 (10 pages).
NCBI Protein Database Accession No. P08289. Retrieved on Apr. 16, 2013 (5 pages).
NCBI Protein Database Accession No. P09242. Retrieved on Apr. 16, 2013 (6 pages).
NCBI Protein Database Accession No. P09487. Retrieved on Apr. 16, 2013 (4 pages).
NCBI Protein Database Accession No. P09923. Retrieved on Apr. 16, 2013 (6 pages).
NCBI Protein Database Accession No. P10696. Retrieved on Apr. 16, 2013 (7 pages).
NCBI Protein Database Accession No. Q29486. Retrieved on Apr. 16, 2013 (3 pages).
NCBI Protein Database Accession No. Q9N0V0. Retrieved on Apr. 16, 2013 (1 page).
NCBI Protein Database Accession No. XP_001109717. Retrieved on Apr. 17, 2013 (1 page).
Nishioka et al., "Enhancement of drug delivery to bone: characterization of human tissue-nonspecific alkaline phosphatase tagged with an acidic oligopeptide," Mol Genet Metab. 88:244-255 (2006).
Nosjean et al., "Human tissue non-specific alkaline phosphatases: sugar-moiety-induced enzymic and antigenic modulations and genetic aspects," Biochem J. 321:297-303 (1997).
Oda et al., "A general method for rapid purification of soluble versions of glycosylphosphatidylinositol-anchored proteins expressed in insect cells: An application for human tissue-nonspecific alkaline phosphatase," J Biochem. 126:694-699 (1999).
Ramachandran et al., "Treatment of an anabolic bone deficiency in neurofibromatosis with bone morphogenetic proteins and its potential application for congenital pseudarthrosis of the tibia," J Bone Joint Surg Br. 91-B:abstract 137 (2009).
Rezende et al., "Inorganic pyrophosphate-phosphohydrolitic activity associated with rat osseous plate alkaline phosphatase," Cell Mol Biol. 44:293-302 (1998).
Urlaub et al., "Deletion of the diploid dihydrofolate reductase locus from cultured mammalian cells," Cell. 33:405-412 (1983).
Wang et al., "A mouse model for achondroplasia produced by targeting fibroblast growth factor receptor 3," Proc Natl Acad Sci USA. 96:4455-4460 (1999).
Wang et al., "Mice lacking Nf1 in osteochondroprogenitor cells display skeletal dysplasia similar to patients with neurofibromatosis type 1," Hum Mol Genet. 20(20):3910-3924 (2011).
Waymire et al., "Mice lacking tissue non-specific alkaline phosphatase die from seizures due to defective metabolism of vitamin B-6," Nat Genet. 11:45-51 (1995).
Weiss et al., "A missense mutation in the human liver/bone/kidney alkaline phosphatase gene causing a lethal form of hypophosphatasia," Proc Natl Acad Sci USA. 85:7666-7669 (1988).

Weninger et al., "Biochemical and morphological effects of human hepatic alkaline-phosphatase in a neonate with hypophosphatasia," Acta Paediatr Scand. 154-160 (1989).
Whyte et al., "Alkaline phosphatase: Placental and tissue non-specific isoenzymes hydrolyze phosphoethanolamine, inorganic pyrophosphate, and pyridoxal 5'-phosphate," J Clin Invest. 95:1440-1445 (1995).
Whyte et al., "Enzyme replacement therapy for infantile hypophosphatasia attempted by intravenous infusions of alkaline phosphatase," J Pediatr. 105(6):926-933 (1984).
Whyte et al., "Infantile hypophosphatasia: Enzyme replacement therapy by intravenous infusion of alkaline phosphatase-rich plasma from patients with paget bone disease," J Pediatr. 101:379-386 (1982).
Whyte et al. Hypophosphatasia. *The Metabolic and Molecular Bases for Disease*. McGraw-Hill Book Company, 5313 (2001).
Whyte et al., "Markedly increased circulating pyridoxal-5'-phosphate levels in hypophosphatasia," J Clin Invest. 76:752-756 (1985).
Whyte et al., "Marrow cell transplantation for infantile hypophosphatasia," J Bone Miner Res. 18:624-636 (2003).
Whyte. Hypophosphatasia: Nature's window on alkaline phosphatase function in man. *Principles of Bone Biology*. JJ Bilezikian, LG Raisz, and GA Rodan. London: Academic Press,1229-1248 (2002).
Zurutuza et al., "Correlations of genotype and phenotype in hypophosphatasia," Hum Mol Genet. 8(6):1039-1046 (1999).
International Search Report and Written Opinion for International Application No. PCT/US12/39004, mailed Nov. 2, 2012 (22 pages).
International Search Report for International Patent Application No. PCT/US2012/060869, mailed Mar. 25, 2013 (5 pages).
Achord et al., "Human β-glucuronidase: In vivo clearance and in vitro uptake by a glycoprotein recognition system on reticuloendothelial cells," Cell. 15:269-278 (1978).
Addison et al., "Pyrophosphate inhibits mineralization of osteoblast cultures by binding to mineral, up-regulating osteopontin, and inhibiting alkaline phosphate activity," J Biol Chem. 282(21):15872-15883 (2007).
Altarescu et al., "The efficacy of enzyme replacement therapy in patients with chronic neuronopathic Gaucher's disease," J Pediatr. 138(4):539-547 (2001).
Barranger et al., "Lessons learned from the development of enzyme therapy for Gaucher disease," J Inherit Metab Dis. 24(Supp 2):89-96 (2001).
Barton et al., "Replacement therapy for inherited enzyme deficiency—macrophage-targeted glucocerebrosidase for Gaucher's disease," N Engl J Med. 324(21):1464-1470 (1991) (Abstract only).
Bennett et al., "Extracellular domain-IgG fusion proteins for three human natriuretic peptide receptors," J Biol Chem. 266(34):23060-23067 (1991).
Bernardi, "Chromatography of proteins on hydoxyapatite," Methods Enzymol. 27:471-479 (1973).
Bobé et al., "Fas-mediated liver damage in MRL hemopoietic chimeras undergoing Ipr-mediated graft-versus-host disease," J Immunol. 159:4197-4204 (1997).
Bonilla, "Pharmacokinetics of immunoglobulin administered via intravenous or subcutaneous routes," Immunol Allergy Clin N Am. 28:803-819 (2008).
Boskey et al. "Matrix vesicles promote mineralization in a gelatin gel," Calcif Tissue Int. 60:309-315 (1997).
Boskey, "Amorphous calcium phosphate: The contention of bone," J Dent Res. 76:1433-1436 (1997).
Byers et al., "Effect of enzyme replacement therapy on bone formation in a feline model of mucopolysaccharidosis type VI," Bone. 21(5):425-431 (1997).
Campbell et al., "Insulin-like growth factor (IGF)-binding protein-5-(201-218) region regulates hydroxyapatite and IGF-I binding," Am J Physiol. 273:E1005-1013 (1997).
Ciancaglini et al., "Contribution of matrix vesicles and alkaline phosphatase to ectopic bone formation," Braz J Med Biol Res. 39:603-610 (2006).
Cleland et al., "Emerging protein delivery methods," Curr Opin Biotechnol. 12:212-219 (2001).

(56) References Cited

OTHER PUBLICATIONS

Crawley et al., "Enzyme replacement therapy in a feline model of Maroteaux-Lamy Syndrome," J Clin Invest. 97(8):1864-1873 (1996).
Data Sheet for pFUSE-SEAP-hFC "Plasmid designed for the expression of a SEAP-Fc Fusion protein," Invivogen, San Diego, CA (4 pages) (1989).
Declaration of Dr. Philippe Crine for EP 08757088.3, executed Jan. 14, 2011 (6 pages).
Dumont et al., "Monomeric Fc fusions: impact on pharmacokinetic and biological activity of protein therapeutics," BioDrugs. 20(3):151-160 (2006).
EBI Blast for Accession No. ATD17216. Entered Oct. 16, 2008 (1 page).
Eng et al., "Safety and efficacy of recombinant human α-Galactosidase a replacement therapy in Fabry's Disease," N Engl J Med. 345(1):9-16 (2001).
Engel et al., "Characterization of the hormone binding site of natriuretic peptide receptor-C," FEBS Lett. 360:169-172 (1995).
European Search Report for European Application No. EP08757088, dated Jun. 21, 2010 (6 pages).
Extended European Search Report for European Application No. 11774253.6, dated Oct. 14, 2013 (8 pages).
Extended European Search Report for European Application No. EP 11 00 0196.3, mailed Jun. 22, 2011 (6 pages).
Extended European Search Report for European Application No. EP 11 00 4496, mailed Aug. 26, 2011 (7 pages).
Fujisaki et al., "Osteotropic Drug Delivery System (ODDS) based on bisphosphonic prodrug. IV effects of osteotropic estradiol on bone mineral density and uterine weight in ovariectomized rats," J Drug Target. 5(2):129-138 (1997).
Fujisawa et al., "Acidic amino acid-rich sequences as binding sites of osteonectin to hydroxyapatite crystals," Biochim Biophys Acta. 1292:53-60 (1996).
Furbish et al., "Uptake and distribution of placental glucocerebrosidase in rat hepatic cells and effects of sequential deglycosylation," Biochim Biophys Acta. 673:425-434 (1981).
Garg, *Investigation of the role of FcRn in the absorption, distribution, and elimination of monoclonal antibodies*. Dissertation: State University of New York at Buffalo, 2007 (Abstract only) (2 pages).
Gilbert et al., "Chimeric peptides of statherin and osteopontin that bind hydroxyapatite and mediate cell adhesion," J Biol Chem. 275(21):16213-16218 (2000).
Guo et al., "Protein tolerance to random amino acid change," Proc Natl Aced Sci USA. 101(25):9205-9210 (2004).
Hailing Linder et al., "Glycosylation differences contribute to distinct catalytic properties among bone alkaline phosphotase isoforms," Bone. 45(5):987-993 (2009) (17 pages).
Hardy et al., "Dissection of a carboxy-terminal region of the yeast regulatory protein RAP1 with effects on both transcriptional activation and silencing," Mol Cell Biol. 12(3):1209-1217 (1992).
Hosain et al., "Targeted delivery of antineoplastic agent to bone: biodistribution studies of technetium-99m-labeled gem-bisphosphonate conjugate of methotrexate," J Nucl Med. 37(1):105-107 (1996).
Hult et al., "Engineered enzymes for improved organic synthesis," Curr Opin Biotechnol. 14:395-400 (2003).
Hunter et al., "Modulation of crystal formation by bone phosphoproteins: structural specificity of the osteopontin-mediated inhibition of hydroxyapatite formation," Biochem J. 300:723-728 (1994).
Husain et al., "Fc site-specific labeling of immunoglobulins with calf intestinal alkaline phosphatase," Bioconjug Chem. 5(5):482-90 (1994).
International Preliminary Report on Patentability for International Patent Application No. PCT/US2012/060869, dated Apr. 22, 2014 (7 pages).
International Search Report and Writen Opinion for International Applicaiton No. PCT/CA2011/050807, mailed Apr. 13, 2012 (18 pages).
International Search Report and Written Opinion for International Application No. PCT/CA2005/000615, mailed Aug. 18, 2005 (14 pages).
International Search Report and Written Opinion for International Application No. PCT/CA2008/000923, mailed Sep. 12, 2008 (11 pages).
International Search Report and Written Opinion for International Application No. PCT/CA2011/050258, mailed Jul. 29, 2011 (14 pages).
Jin et al., "Novel analog of atrial natriuretic peptide selective for receptor-A produces increased diuresis and natriuresis in rats," J Clin Invest. 98(4):969-976 (1996).
Kakkis et al., "Enzyme-replacement therapy in mucopolysaccharidosis I," N Engl J Med. 344(3):182-188 (2001).
Kasugai et al., "Selective drug delivery system to bone: small peptide $(Asp)_6$ conjugation," J Bone Miner Res. 15(5):936-943 (2000).
Kaufmann et al., "Influence of low temperature on productivity, proteome and protein phosphorylation of CHO cells," Biotechnol Bioeng. 63(5):573-582 (1999).
Kochendoerfer, "Protein & peptide drug delivery—third international conference: Minimally invasive delivery methods," IDrugs. 6(11):1043-1045 (2003).
Leone et al., "Allosteric modulation of pyrophosphatase activity of rat osseous plate alkaline phosphatase by magnesium ions," Int J Biochem Cell Biol. 30:89-97 (1998).
Michigami et al., "Common mutations F310L and T1559del in the tissue-nonspecific alkaline phosphatase gene are related to distinct phenotypes in Japanese patients with hypophosphatasia," Eur J Pediatr. 164:277-282 (2005).
Milián et al., "Enzyme replacement therapy for murine hypophosphatasia." J Bone Miner Res. 23(6): 777-787 (2008) (Epublished ahead of print on Dec. 17, 2007).
Moss et al., "Association of inorganic-pyrophosphatase activity with human alkaline-phosphatase preparations," Biochem J. 102:53-57 (1967).
Murray, "Lectin-specific targeting of lysosomal enzymes to reticuloendothelial cells," Methods Enzymol. 149:25-42 (1987).
NCBI Protein Database Accession No. NP_001253798.1, downloaded on Apr. 17, 2013. (2 pages).
NCBI Protein Database Accession No. NP_001622, donwloaded on Apr. 16, 2013.
NCBI Protein Database Accession No. NP_031457, donwloaded on Apr. 16, 2013.
NCBI Protein Database Accession No. NP_037191, donwloaded on Apr. 16, 2013.
NCBI Protein Database Accession No. NP_776412, donwloaded on Apr. 17, 2013.
NCBI Protein Database Accession No. NP_789828, donwloaded on Apr. 16, 2013.
NCBI Protein Database Accession No. P01857.1, donwloaded on Apr. 18, 2013 (7 pages).
NCBI Protein Database Accession No. Q6PYX1. Retrieved on Oct. 15, 2013 (2 pages).
NCBI Protein Database Accession No. XP-001109717. Retrieved on Apr. 17, 2013.
Ngo et al., Computational complexity, protein structure prediction, and the levinthal paradox. *The Protein Folding Problem and Tertiary Structure Prediction*. Merz et al. (ed.), 433, 492-495 (1994).
Official Notification and Search Report for Eurasian Patent Application No. 201291138, dated May 17, 2013 (3 pages).
Oikawa et al., "Enzyme replacement therapy on hypophosphatasia mouse model," J Inherit Metab Dis. 1-9 (2013).
Patti et al., "Critical residues in the ligand-binding site of the *Staphylococcus aureus* collagen-binding adhesin (MSCRAMM)," J Biol Chem. 270(20):12005-12011 (1995).
Pedersen et al., "Removal of N-terminal polyhistidine tags from recombinant proteins using engineered aminopeptidases," Prot Expr Purifi. 15:389-400 (1999).
Rowe et al., "MEPE, a new gene expressed in bone marrow and tumors causing osteomalacia," Genomics. 67:54-68 (2000).
Russell et al., "Inorganic pyrophosphate in plasma in normal persons and in patients with hypophosphatasia, osteogenesis imperfecta, and other disorders of bone," J Clin Invest. 50:961-969 (1971).

(56) References Cited

OTHER PUBLICATIONS

Salih et al., "Identification of the phosphorylated sites of metabolically $_{32}$P-labeled osteopontin from cultured chicken osteoblasts," J Biol Chem. 272(21):13966-13973 (1997).

Sands et al., "Enzyme replacement therapy for murine mucopolysaccharidosis type VII," J Clin Invest. 93:2324-2331 (1994).

Sekido et al., "Novel drug delivery system to bone using acidic oligopeptide: pharmacokinetic characteristics and pharmacological potential," J Drug Target. 9(2):111-121 (2001).

Sharom et al., "Glycosylphosphatidylinositol-anchored proteins: structure, function, and cleavage by phosphatidylinositol-specific phospholipase C," Biochem Cell Biol. 80:535-549 (2002).

Shull et al., "Enzyme replacement in a canine model of Hurler syndrome," Proc Natl Acad Sci USA. 91(26):12937-12941 (1994).

Spears et al., "Deoxyuridylate effects on thymidylate synthase-5-fluorodeoxyuridylate-folate ternary complex formation," Biochem Pharmacol. 38:2985-2993 (1989).

Srinivas et al., "Assessment of dose proportionality, absolute bioavailability, and immunogenicity response of CTLA4Ig (BMS-188667), a novel immunosuppressive agent, following subcutaneous and intravenous administration to rats," Pharm Res. 14(7):911-916 (1997).

Stahl et al., "Evidence for receptor-mediated binding of glycoproteins, glycoconjugates, and lysosomal glycosidases by alveolar macrophages," Proc Natl Acad Sci USA. 75(3):1399-1403 (1978).

Sturtz et al., "A study of the delivery-targeting concept applied to antineoplasic drugs active on human osteosarcoma. I. Synthesis and biological activity in nude mice carrying human osteosarcoma xenografts of gem-bisphosphonic methotrexate analogues," Eur J Med Chem. 27:825-833 (1992).

Supplementary European Search Report for European Application No. EP 05739065, date of completion Nov. 7, 2008 (2 pages).

Supplementary European Search Report for European Patent Application No. 08757088.3, dated Jun. 21, 2010 (7 pages).

Supplementary European Search Report for European Patent Application No. 11853820.6, mailed Mar. 25, 2014 (3 pages).

Symersky et al., "Structure of the collagen-binding domain from a *Staphylococcus aureus* adhesin," Nat Struct Biol. 4(10):833-838 (1997).

Tomatsu, Declaration Under 37 C.F.R. § 1.132 for U.S. Appl. No. 11/484,870, dated Jun. 1, 2009 (3 pages).

Tomatsu, Declaration Under 37 C.F.R. § 1.132 for U.S. Appl. No. 11/484,870, dated Nov. 27, 2007 (2 pages).

Tye et al., "Delineation of the hydroxyapatite-nucleating domains of bone sialoprotein," J Biol Chem. 278(10):7949-7955 (2003).

Uludag et al., "Bone affinity of a bisphosphonate-conjugated protein in vivo," Biotechnol Prog. 16:1115-1118 (2000).

Wang et al., "Structure-based chemical modification strategy for enzyme replacement treatment of phenylketonuria," Mol Genet Metab. 86:134-140 (2005).

Weinberg, "An overview of infliximab, etanercept, efalizumab, and alefacept as biologic therapy for psoriasis," Clin Ther. 25(10):2487-2505 (2003).

Weiss et al., "Isolation and characterization of a cDNA encoding a human liver/bone/kidney-type alkaline phosphatase," Proc Natl Aced Sci USA. 83:7182-7186 (1986).

Weiss et al., "Structure of the human liver/bone/kidney alkaline phosphatase gene," J Biol Chem. 263(24):12002-12010 (1988).

Whyte et al., "Enzyme-replacement therapy in life-threatening hypophosphatasia," N Engl J Med. 366(10):904-913 (2012).

Whyte et al., "Infantile hypophosphatasia: normalization of circulating bone alkaline phosphatase activity followed by skeletal remineralization. Evidence for an intact structural gene for tissue nonspecific alkaline phosphatase," J Pediatr. 108(1):82-88 (1986).

Whyte, "Hypophosphatasia and the role of alkaline phosphatase in skeletal mineralization," Endocr Rev. 15(4):439-461 (1994).

Whyte, "Hypophosphatasia," *The Metabolic and Molecular Bases of Inherited Disease* (8th ed.), pp. 5313-5329 (2001) (McGraw-Hill Book Company) (epub pp. 1-41).

Whyte, Heritable forms of rickets and osteomalacia. *Connective Tissues and Its Heritable Disorders*, Royce and Steinmann, Wiley-Liss, 765-787 (2002).

Wroblewski et al., "Pharmacokinetics, metabolic stability, and subcutaneous bioavailability of a genetically engineered analog of DcR3, flint [DcR3(R218Q)], in cynomolgus monkeys and mice," Drug Metab Dispos. 31(4):502-507 (2003).

Yadav et al., "Dose response of bone-targeted enzyme replacement for murine hypophosphatasia," Bone. 49(2):250-6 (2011) (20 pages).

Yokogawa et al., "Selective delivery of estradiol to bone by aspartic acid oligopeptide and its effects on ovariectomized mice," Endocrinology. 142(3):1228-1233 (2001).

Young et al., "Structure, expression, and regulation of the major noncollagenous matrix proteins of bone," Clin Orthop Relat Res. 281:275-294 (1992).

Zierhut et al., "Population PK-PD model for Fc-osteoprotegerin in healthy postmenopausal women," J Pharmacokinet Pharmacodyn. 35:379-399 (2008).

International Preliminary Report on Patentability for International Patent Application No. PCT/US2012/039004, dated Apr. 22, 2014 (8 pages).

Siris et al., "Paget's disease of bone," Trends Endocrinol Metab. 2(6):207-12 (1991).

European Search Report for European Patent Application No. 12842640.0, issued Mar. 13, 2015 (7 pages).

Lee et al., "Disturbed osteoblastic differentiation of fibrous hamartoma cell from congenital pseudarthrosis of the tibia associated with neurofibromatosis type I", Clin Orthop Surg. 3(3):230-7 (2011).

Schindeler et al., "Modeling bone morphogenetic protein and bisphosphonate combination therapy in wild-type and Nf1 haploinsufficient mice," J Orthop Res. 26(1):65-74 (2008).

Office Action, dated Oct. 27, 2015, from the Japanese Patent Office (3 pages).

* cited by examiner

FIG. 1

Multiple Sequence Alignment of Natriuretic Peptides

```
Human ANP        -----SLRRSSCFGGRMDRIGAQSGLGCNSFRY-----------        (SEQ ID NO: 1)
Human urodilatin TAPRSLRRSSCFGGRMDRIGAQSGLGCNSFRY-----------        (SEQ ID NO: 2)
Human BNP        -SPKMVQGSGCFGRKMDRISSSSGLGCKVLRRH----------        (SEQ ID NO: 3)
Human CNP22      --------GLSKGCFGLKLDRIGSMSGLGC-------------        (SEQ ID NO: 4)
DNP              -----EVKYDPCFGHKIDRINHVSNLGCPSLRDPRPNAPSTSA       (SEQ ID NO: 5)
                      ***  :***  .  *.  ****
                 CFGXXXDRIXXXSXLGC                                 (SEQ ID NO: 6)

CONSENSUS SEQUENCE
```

FIG. 2

Sequences of Human CNP53, CNP22, and CNP (ring only)

```
Human CNP53       DLRVDTKSRAAWARLLQEHPNARKYKGANKKGLSKG CFGLKLDRIGSMSGLGC  (SEQ ID NO: 11)
Human CNP22       ---------------------------------GLSKG CFGLKLDRIGSMSGLGC  (SEQ ID NO: 4)
Human CNP (ring only) ------------------------------------ CFGLKLDRIGSMSGLGC  (SEQ ID NO: 12)
```

FIG. 3
Multiple Sequence Alignment of C-Type Natriuretic Peptides from Various Species

```
Human                        -----GLSKGCFGLKLDRIGSMSGLGC  (SEQ ID NO: 4)
Bovine                       -----GLSKGCFGLKLDRIGSMSGLGC  (SEQ ID NO: 13)
Sheep                        -----GLSKGCFGLKLDRIGSMSGLGC  (SEQ ID NO: 14)
Mouse                        -----GLSKGCFGLKLDRIGSMSGLGC  (SEQ ID NO: 15)
Pig                          -----GLSKGCFGLKLDRIGSMSGLGC  (SEQ ID NO: 16)
Micrurus fulvius fulvius     GLAKEALGDGCFGLKLDRIGTSSGLGC  (SEQ ID NO: 17)
Taeniopygia guttata          --------GCFGLKLDRIGTFSGLGC   (SEQ ID NO: 18)
Chicken                      -----GLSRSCFGVKLDRIGSMSGLGC  (SEQ ID NO: 19)
Rana catesbeiana             -----SRGCFGVKLDRIGAFSGLGC    (SEQ ID NO: 20)
Eel                          -----GWNRGCFGLKLDRIGSLSGLGC  (SEQ ID NO: 21)
Trout                        -----GWNRGCFGLKLDRIGSMSGLGC  (SEQ ID NO: 22)
Ornithorhynchus anatinus     -----GLSKGCFGLKLDRIGSTSGLGC  (SEQ ID NO: 23)
Trimeresurus flavoviridis    ------KGCFGHKLDRIGSTSGLGC    (SEQ ID NO: 24)
Polypterus endlicheri        -------SKGCFGLKLDRIGSISGLGC  (SEQ ID NO: 25)
Xenopus laevis               -----LSKGCFGLKLDRIGVVSGLGC   (SEQ ID NO: 26)
Oryzias latipes              --------GCFGMKMDRIGSISGLGC   (SEQ ID NO: 27)
Tetraodon nigroviridis       --------GCFGMKIDRIGSISGLGC   (SEQ ID NO: 28)
Pseudechis australis         -----SKIGDGCFGLPLDHIGSVSGLGC (SEQ ID NO: 29)
                                  ***  :*:::*   *****
CONSENSUS SEQUENCE           XXXXXXXXXXXCFGXXXDXIGXXSGLGC (SEQ ID NO: 30)
```

FIG. 4A
Multiple Alignment of C-Type Natriuretic Peptides from Various Species

```
sp|Q8AYR5|ANFC2_ORYLA      ---MAVCSSSS---------LILLTVFLSVAVETRP-SSDRDE-------- 30
sp|Q805D5|ANFC2_TAKRU      ---MAASSSSF---------VPLVLLFLAIPVEPRP-SMTRDE-------- 30
sp|Q76KW6|ANFC_ACITR       ---MSISSSSSSSSSSSSCLLLISLMLLAASCQGRPDLQHRNH-------- 40
sp|Q61839|ANFC_MOUSE       ------MHLSQLI-------ACALLLALLSLRPSEAKPGTP---------- 28
tr|Q544K5|Q544K5_MOUSE     ------MHLSQLI-------ACALLLALLSLRPSEAKPGTP---------- 28
tr|Q8VHG9|Q8VHG9_NOTAL     ------MHLSQLI-------ACALLLALLSLRPSEAKPGTP---------- 28
sp|P55207|ANFC_RAT         ------MHLSQLI-------ACALLLALLSLRPSEAKPGTP---------- 28
sp|P55206|ANFC_BOVIN       ------MHLSQLL-------ACALLLALLSLRPSEAKPGAP---------- 28
sp|P56283|ANFC_SHEEP       --------MHLSQLL-----ACALLLSLLSLRPSEAKPGAP---------- 28
sp|P18104|ANFC_PIG         ------MHLSQLL-------ACALLLTLLSLRPSEAKPGAP---------- 28
sp|P23582|ANFC_HUMAN       ------MHLSQLL-------ACALLLTLLSLRPSEAKPGAP---------- 28
sp|P84715|ANF39_ORNAN      ------MHLSHLL-------AWALLLTLLSLR-AEAKPPSPQ--------- 28
tr|Q9QZ96|Q9QZ96_CAVPO     -------------------------------------------------- 
sp|Q8UOI7|ANFC4_ORYLA      ------MNLSYLV-------ACGLLVTFLSDK-MDAQPLTPAQ-------- 29
sp|Q805D3|ANFC4_TAKRU      ------MNLSYLV-------ACGLMITLLSVR-MGAKPLSQAQ-------- 29
tr|C1BXI5|C1BXI5_ESOLU     ------MNISYLV-------ACGLMITLLSVR-SGAKPLYAAQ-------- 29
tr|D2KXA5|D2KXA5_ANGJA     ------MNVSQLM-------VCGLLMALFSFS-TEAKSLIPAQ-------- 29
tr|Q1XGY7|Q1XGY7_9ACTI     --------MNISHLV-----ACGLLVALLTVT-MEAKPLTQSQ-------- 29
sp|P49756|ANFD_RANCA       ------MHFCHIV-------GWGLVLAVLYLR-TEAKPVAQAH-------- 29
sp|P0C7P5|BNP_TRIFL        -----MFVSRLA--------ASGLLLLALLALSLDGKPVHQSKPGR------ 33
sp|P0C7P6|BNP_TRIGA        ------MFVSRLA-------ASGLLLLALLALSLDGKPVQE-KPGR------ 32
sp|Q6LEM5|BNP1_BOTJA       -----MVLSRLA--------ASGLLLLALLALSVDGKPVQQWAQS------- 32
sp|Q9PW56|BNP2_BOTJA       -----MVLSRLA--------ASGLLLLALLALSVDGKPVQQWAQGG------ 33
sp|P68515|BNP_BOTIN        -----MVLSRLA--------ASGLLLLALLALSVDGKPVQQWAQGG------ 33
sp|Q90Y12|BNP_CRODU        -----MFVSRLA--------ASGLLLLALLAVSLDGKPLQQWS--------- 30
sp|Q2PE51|BNP_CRODO        -----MFVSRLA--------ASGLLLLALLAVSLDGKPLQQWS--------- 30
sp|B0VXV8|BNP_SISCA        -----MFVSRLA--------ASGLLLLALLAVSLDGKPVQQWS--------- 30
sp|Q27J49|BNP_LACMU        -----MFVSRLA--------ASGLLLLALLAVSLDGKPVQQWSH-------- 31
sp|P01021|BNP_ACKHA        --------MFVSRLA-----ASGLLLLALMALSLDGKPVQQWSQGRPPGPPI 39
sp|Q09GK2|VNP_PHIOL        -----MVASRLA--------AGGLLLLALLALALDGKPAFP-QP-------- 30
tr|D1MZV3|D1MZV3_RHATT     -----MFASRLA--------ALGLLLLALV---LDGKPAFPPQP-------- 28
tr|Q7T1M4|Q7T1M4_BOTJR     -------HEKPSRSG-----AKSAAVGAKLAASSDSAADECSSGRK------ 34
tr|Q402A2|Q402A2_PETMA     -------------------------------------------------- 
tr|Q402A3|Q402A3_LAMJA     --MKIQLLMMV---------VVVGSWTFLG---VGAKPLTSYELYD------ 32
tr|Q402A1|Q402A1_9PETR     ---MRRQVLVMV--------VMVVVMVVMSGKSVTAKPVASYELLD------ 35
sp|P21805|ANFC_CHICK       -------------------------------------------------- 
tr|A9CDT6|A9CDT6_CHICK     ------MKLLFC--------PGFFLLLIVSQKQAMAKPIS----------- 26
sp|P20968|ANFC_RANCA       -----MSYKRGTC-------LGFIMLLMVSHHHTKGKPLS----------- 28
sp|P55208|ANFC_IRISC       ----MSGQISFY--------CGLLLVLLIQAQ---ARPRS---------- 25
sp|P23259|ANFC_SCYCA       --------------------------------RPRS-------------- 4
sp|P41319|ANFC_SQUAC       ----MSGHISFY--------CGLLLLLLIQVQ---ARPRA---------- 25
tr|Q2MH72|Q2MH72_9CHON     ----MSGNTNFY--------CGLVLLLLLQVQ---GRPRS---------- 25
tr|Q2MH73|Q2MH73_9CHON     ----MSGNTNFY--------CGLVLLLLLQVQ---GRPRS---------- 25
tr|Q2MH71|Q2MH71_9CHON     ----MSGNTNFY--------CGLVLLLLLQVQ---GRPRS---------- 25
tr|Q2MH74|Q2MH74_DASAK     ----MSGNTNFY--------CGLVLLLLLQVQ---GRPRS---------- 25
tr|Q2PF87|Q2PF87_CALMI     ------MNAHVSFP------CGLMLLLLIQVQVQ-ARPRTG---------- 28
sp|Q8OO18|ANFC3_ORYLA      ------MSLRAF--------MLCVCLLLQSVG---ARPAS---------- 23
tr|Q4ADV1|Q4ADV1_ORYLA     ------MSLRAF--------MLCVCLLLQSVG---ARPAS---------- 23
sp|Q805D4|ANFC3_TAKRU      ------MSLNLPGY------ALFFILLVASSG---AKPAP---------- 25
tr|C0H7B0|C0H7B0_SALSA     -MKMISNIQFF---------CLTALVLLNLVG---ANPMS---------- 27
tr|C1BWD1|C1BWD1_ESOLU     ---MISNIQFC---------CLSVLVLLNLVG---AKPVS---------- 25
tr|D2KXA3|D2KXA3_ANGJA     ---MISNITIY---------CISSLLFLNLVG---GKPVS---------- 25
tr|B3DJJ2|B3DJJ2_DANRE     ---MIANISVF---------CVSSLLLLNLVG---AKPVS---------- 25
tr|Q1XGY8|Q1XGY8_9ACTI     ---MVSRLTVY---------CALFIIVLSQVS---AKPVS---------- 25
sp|Q8AXR2|ANFC2_ONCMY      ----ML---YPA--------LLCAALLLTIAPLGHTEGRTLYPSPD----- 30
sp|Q8AXR3|ANFC1_ONCMY      ----ML---YPA--------LLCAALLLTIAPLGHTEGRTLHPSPD----- 30
tr|C1BKS8|C1BKS8_OSMMO     ----ML---CPV--------LLCATLVLLFPLELSEGRALHPSPE------ 30
tr|Q805E7|Q805E7_OREMO     ----ML---CPV--------LLCAALLLLTPLEITEARALHPSPD------ 30
tr|C3KH23|C3KH23_ANOFI     ----ML---CPV--------LLCATLLLLTPLEITEARALHPPD------- 30
sp|Q8AYR6|ANFC1_ORYLA      ------ML---CPV------LLCATLLLLTPFEVTEARALHPSAD------ 30
sp|Q805D6|ANFC1_TAKRU      ----ML---CPA--------LLCATLLLLTPVEITDARALQQPSD------ 30
sp|P18145|ANFC_ANGJA       ----MM---CKA--------LVFAVLLLAVPLERADSRALRTPVD------ 30
tr|Q1XGY9|Q1XGY9_9ACTI     ------MMGSCSAPLLIGHRILCLFLLMASSLSPIESRAFRSPP------ 36
tr|A9CDT5|A9CDT5_CHICK     MLGLPA--------------WPCSLFLLLVLLSASVQAMSSSGQR------ 31
```

FIG. 4B
Multiple Alignment of C-Type Natriuretic Peptides from Various Species

```
sp|Q8AYR5|ANFC2_ORYLA        ..........................................
sp|Q805D5|ANFC2_TAKRU        ..........................................
sp|Q76KW6|ANFC_ACITR         ------------------------------------------
sp|Q61839|ANFC_MOUSE         ------------------------------------------
tr|Q544K5|Q544K5_MOUSE       ------------------------------------------
tr|Q8VHG9|Q8VHG9_NOTAL       ------------------------------------------
sp|P55207|ANFC_RAT           ..........................................
sp|P55206|ANFC_BOVIN         ------------------------------------------
sp|P56263|ANFC_SHEEP         ------------------------------------------
sp|P18104|ANFC_PIG           ------------------------------------------
sp|P23582|ANFC_HUMAN         ------------------------------------------
sp|P84715|ANFS9_ORNAN        ..........................................
tr|Q9QZ96|Q9QZ96_CAVPO       ------------------------------------------
sp|Q800T7|ANFC4_ORYLA        ------------------------------------------
sp|Q805D3|ANFC4_TAKRU        ------------------------------------------
tr|C1BX15|C1BX15_ESOLU       ..........................................
tr|D2KXA5|D2KXA5_ANGJA       ------------------------------------------
tr|Q1XGY7|Q1XGY7_9ACTI       ------------------------------------------
sp|P40756|ANFD_RANCA         ------------------------------------------
sp|P0C7P5|BNP_TRIFL          --------------SPPIS----------------------- 38
sp|P0C7P6|BNP_TRIGA          ---------SPPISPLLVP-----------PPPPPPHWPPP- 53
sp|Q6LEM5|BNP1_BOIJA         ----------WP--GPNIPPLKVQQWAQGGWPRPGPEIPPLTVQQWAQN- 69
sp|Q9PW56|BNP2_BOIJA         ----------WPRPGPETPPLKVQQWAQGGWPRPGPEIPPLTVQQWAQN- 72
sp|P68515|BNP_BOTIN          ----------WPRPGPEIPPLKVQQWAQGGWPRPGPEIPPLTVQQWAQN- 72
sp|Q80Y12|BNP_CRODU          ----------------------------------QRWP---- 34
sp|Q2PE51|BNP_CRODO          ----------------------------------QRWP---- 34
sp|B0VXV8|BNP_S1SCA          ----------------------------------QNWPG--- 35
sp|Q27J49|BNP_LACMU          ---------KGWPPRPQIPPLVVQQWSQKPWP-PGHHIPPVVVQEWPP-- 69
sp|P01021|BNP_AGKHA          PRLVVQQWSQGLPPGPPIPRLVVQQWSQG-LP-PGPPIPPLVVQQWSQGL 87
sp|Q09GK2|VNP_PHIOL          ------------------------------------------
tr|D1MZV3|D1MZV3_RHATT       ------------------------------------------
tr|Q7T1M4|Q7T1M4_BOTJR       -----------------------------------GEPPG- 39
tr|Q402A2|Q402A2_PETMA       ------------------------------------------
tr|Q402A3|Q402A3_LAMJA       ------------------------------------------
tr|Q402A1|Q402A1_9PETR       ..........................................
sp|P21805|ANFC_CHICK         ..........................................
tr|A9CDT6|A9CDT6_CHICK       ------------------------------------------
sp|P20968|ANFC_RANCA         ------------------------------------------
sp|P55208|ANFC_TRISC         ------------------------------------------
sp|P23259|ANFC_SCYCA         ------------------------------------------
sp|P41319|ANFC_SQUAC         ------------------------------------------
tr|Q2MH72|Q2MH72_9CHON       ------------------------------------------
tr|Q2MH73|Q2MH73_9CHON       ------------------------------------------
tr|Q2MH71|Q2MH71_9CHON       ------------------------------------------
tr|Q2MH74|Q2MH74_DASAK       ..........................................
tr|Q2PF87|Q2PF87_CALMI       ..........................................
sp|Q800I8|ANFC3_ORYLA        ..........................................
tr|Q4ADV1|Q4ADV1_ORYLA       ------------------------------------------
sp|Q805D4|ANFC3_TAKRU        ------------------------------------------
tr|C0H7B0|C0H7B0_SALSA       ..........................................
tr|C1BWD1|C1BWD1_ESOLU       ------------------------------------------
tr|D2KXA3|D2KXA3_ANGJA       ------------------------------------------
tr|B3DJJ2|B3DJJ2_DANRE       ------------------------------------------
tr|Q1XGY8|Q1XGY8_9ACTI       ------------------------------------------
sp|Q8AXR2|ANFC2_ONCMY        ..........................................
sp|Q8AXR3|ANFC1_ONCMY        ..........................................
tr|C1BKS8|C1BKS8_OSMMO       ------------------------------------------
tr|Q805E7|Q805E7_OREMO       ------------------------------------------
tr|C3KH23|C3KH23_ANOFI       ------------------------------------------
sp|Q8AYR6|ANFC1_ORYLA        ..........................................
sp|Q805D6|ANFC1_TAKRU        ------------------------------------------
sp|P18145|ANFC_ANGJA         ------------------------------------------
tr|Q1XGY9|Q1XGY9_9ACTI       ------------------------------------------
tr|A9CDT5|A9CDT5_CHICK       ------------------------------------------
```

FIG. 4C
Multiple Alignment of C-Type Natriuretic Peptides from Various Species

```
sp|Q8AYR5|ANFC2_ORYLA      ------------------------------------------------
sp|Q805D5|ANFC2_TAKRU      ------------------------------------------------
sp|Q76KW6|ANFC_ACITR       ------------------------------------------------
sp|Q61839|ANFC_MOUSE       ------------------------------------------------
tr|Q544K5|Q544K5_MOUSE     ------------------------------------------------
tr|Q8VHG9|Q8VHG9_NOTAL     ------------------------------------------------
sp|P55207|ANFC_RAT         ------------------------------------------------
sp|P55206|ANFC_BOVIN       ------------------------------------------------
sp|P56283|ANFC_SHEEP       ------------------------------------------------
sp|P18104|ANFC_PIG         ------------------------------------------------
sp|P23582|ANFC_HUMAN       ------------------------------------------------
sp|P84715|ANF39_ORNAN      ................................................
tr|Q9QZ96|Q9QZ96_CAVPO     ------------------------------------------------
sp|Q80017|ANFC4_ORYLA      ................................................
sp|Q805D3|ANFC4_TAKRU      ................................................
tr|C1BXI5|C1BXI5_ESOLU     ................................................
tr|D2KXA5|D2KXA5_ANGJA     ------------------------------------------------
tr|Q1XGY7|Q1XGY7_9ACTI     ................................................
sp|P40756|ANFD_RANCA       ------------------------------------------------
sp|P0C7P5|BNP_TRIFL        --------PLSAQQWMPEGRPPHF--IPPLSVQQWSQGRP----------- 68
sp|P0C7P6|BNP_TRIGA        ---HHIPPLSVQKFPPGWKPTHPHEIPPLEVQQWSQGGP----------- 89
sp|Q6LEM5|BNP1_BOTJA       WPHPQIPPLTVQQWAQ-GRAPGPP-IPPLTVQQWAQGRAPHPPIPPAPLQ 117
sp|Q9PW56|BNP2_BOTJA       WPHPQIPPLTVQQWAQWGRPPGPP-IPPLTVQQWAQARPPHPPIPPAPLQ 121
sp|P68515|BNP_BOTIN        WPHPQIPPLTVQQWAQLGPPPRFQ-IPPLEVQQWAQGRAFHPPIPPAPLQ 121
sp|Q90Y12|BNP_CRODU        ------------------------HLE-IPPLVVQNWK----------- 47
sp|Q2PE51|BNP_CRODO        ------------------------HLE-IPPLVVQNWK----------- 47
sp|B0VXV8|BNP_SISCA        ----PKVPPLVVQQWSQN--WPHPQ-IPPLVVQNWK------------- 64
sp|Q27J49|BNP_LACMU        --GHHIPPLVVQQWSQKKWPPGHH-IPPLVVQKWDP-------------- 102
sp|P01021|BNP_AGKHA        PPRPKIPPLVVQQWSQG-LPPRFK-IPPLVVQKWDP--------------- 121
sp|Q09GK2|VNP_PHIOL        ------------------------------------------------
tr|D1MZV3|D1MZV3_RHATT     ------------------------------------------------
tr|Q7T1M4|Q7T1M4_BOTJR     ----PPIPPLTVQQWAQAR-PPHFP-IPPAPLQKWAPVQK----------- 73
tr|Q402A2|Q402A2_PETMA     ................................................
tr|Q402A3|Q402A3_LAMJA     ................................................
tr|Q402A1|Q402A1_9PETR     ................................................
sp|P21805|ANFC_CHICK       ------------------------------------------------
tr|A9CDT6|A9CDT6_CHICK     ------------------------------------------------
sp|P20968|ANFC_RANCA       ------------------------------------------------
sp|P55208|ANFC_TRISC       ------------------------------------------------
sp|P23259|ANFC_SCYCA       ------------------------------------------------
sp|P41319|ANFC_SQUAC       ------------------------------------------------
tr|Q2MH72|Q2MH72_9CHON     ------------------------------------------------
tr|Q2MH73|Q2MH73_9CHON     ------------------------------------------------
tr|Q2MH71|Q2MH71_9CHON     ------------------------------------------------
tr|Q2MH74|Q2MH74_DASAK     ------------------------------------------------
tr|Q2PF87|Q2PF87_CALMI     ------------------------------------------------
sp|Q80018|ANFC3_ORYLA      ------------------------------------------------
tr|Q4ADV1|Q4ADV1_ORYLA     ------------------------------------------------
sp|Q805D4|ANFC3_TAKRU      ------------------------------------------------
tr|C0H7B0|C0H7B0_SALSA     ------------------------------------------------
tr|C1BWD1|C1BWD1_ESOLU     ------------------------------------------------
tr|D2KXA3|D2KXA3_ANGJA     ------------------------------------------------
tr|B3DJJ2|B3DJJ2_DANRE     ------------------------------------------------
tr|Q1XGY8|Q1XGY8_9ACTI     ------------------------------------------------
sp|Q8AXR2|ANFC2_ONCMY      ------------------------------------------------
sp|Q8AXR3|ANFC1_ONCMY      ------------------------------------------------
tr|C1BKS8|C1BKS8_OSMMO     ------------------------------------------------
tr|Q805E7|Q805E7_OREMO     ................................................
tr|C3KH23|C3KH23_ANOFI     ------------------------------------------------
sp|Q8AYR6|ANFC1_ORYLA      ................................................
sp|Q805D6|ANFC1_TAKRU      ------------------------------------------------
sp|P18145|ANFC_ANGJA       ................................................
tr|Q1XGY9|Q1XGY9_9ACTI     ------------------------------------------------
tr|A9CDT5|A9CDT5_CHICK     ................................................
```

FIG. 4D
Multiple Alignment of C-Type Natriuretic Peptides from Various Species

```
sp|Q8AYR5|ANFC2_ORYLA       ----------------EQVLKSLFGPHLTSL----------------IL 47
sp|Q805D5|ANFC2_TAKRU       ----------------AQVLRALFGARLSSI----------------IS 47
sp|Q76KW6|ANFC_ACITR        ----------------KSQLAGLFGAEVAAL----------------LE 57
sp|Q61839|ANFC_MOUSE        ----------------PKVPRTPPGEELADS----------QAAG 47
tr|Q544K5|Q544K5_MOUSE      ----------------PKVPRTPPGEELADS----------QAAG 47
tr|Q8VHG9|Q8VHG9_NOTAL      ----------------PKVPRTPPGEELADS----------QAAG 47
sp|P55207|ANFC_RAT          ----------------PKVPRTPPGEELAEP----------QAAG 47
sp|P55206|ANFC_BOVIN        ----------------PKVPRTPSGEEVAEP----------QAAG 47
sp|P56283|ANFC_SHEEP        ----------------PKVPRTPPGEEVAEP----------QAAG 47
sp|P18104|ANFC_PIG          ----------------PKVPRTPPGEEVAEP----------QAAG 47
sp|P23582|ANFC_HUMAN        ----------------PKVPRTPPAEELAEP----------QAAG 47
sp|P84715|ANF39_ORNAN       ----------------FQVPRSP-GDEASEA-----------VAAN 46
tr|Q9Q296|Q9Q296_CAVPO      --------------------------------------------------
sp|Q800I7|ANFC4_ORYLA       ----------------QKSLRSLLGEELAEF----------------LESG 48
sp|Q805D3|ANFC4_TAKRU       ----------------QKSFRSLLGEELAEF----------------LESE 48
tr|C1BXI5|C1BXI5_ESOLU      ----------------QKSLRNLLGEELSEF----------------LASG 48
tr|D2KXA5|D2KXA5_ANGJA      ----------------EKSLRNLLGEELSEY----------------LASG 48
tr|Q1XGY7|Q1XGY7_9ACTI      ----------------QKSLRNLLGEELSAY----------------LTSD 48
sp|P40756|ANFD_RANCA        ----------------QKSLRALLGEELAEY----------------LVSG 48
sp|P0C7P5|BNP_TRIFL         ---RSEVPPVVVQPHESPAGGTTAFREELSPG----------PEAASG 103
sp|P0C7P6|BNP_TRIGA         ----RSEL-----VQPHESPAGGTTAFREELSLG----------PEAASG 120
sp|Q6LEM5|BNP1_BOTJA        KWAPLQKWAPLLQPHESPASGTTALREELSLG----------PEAASG 155
sp|Q9PW56|BNP2_BOTJA        KWAPVQKWAPLLQPHESPASGTTALREELSLG----------PEAASG 159
sp|P68515|BNP_BOTIN         KWAPVQKWAPLLQPHESPASGTTALREELSLG----------PEAASG 159
sp|Q90Y12|BNP_CRODU         --------SPTQLQARESPAGGTTALREELSLG----------PEAALD 78
sp|Q2PE51|BNP_CRODO         --------SPTQLQARESPAGGTTALREELSLG----------PEAALD 78
sp|B0VXV8|BNP_SISCA         --------SPTQLQPRESPAGGTTALREELSLG----------PDAALD 95
sp|Q27J49|BNP_LACMU         ---PPI-SPPLLKPHESPAGGTTALREELSLG----------PEAALD 136
sp|P01021|BNP_AGKHA         ---PPVSPPLLLQPHESPAGGTTALREELSLG----------PEAASG 156
sp|Q09GK2|VNP_PHIOL         --------------LRKAPACGTTAWRRELTEQ----------PEGASR 55
tr|D1MZV3|D1MZV3_RHATT      --------------LRKAPACGTTALQRQLTEQQQQQQ------QAEGSSG 59
tr|Q7T1M4|Q7T1M4_BOTJR      -WAPVQKWAPLLQPHESPAGGTTALREELSLG----------PEAASG 110
tr|Q402A2|Q402A2_PETMA      --------------SGSEPWEGG-FLPRVSSSSSSSSG------EVEPLAE 30
tr|Q402A3|Q402A3_LAMJA      --------------DACSEPWEGG-FLPRISSSSSSS---------AERLAD 60
tr|Q402A1|Q402A1_9PETR      --------------DTNSEPWEGGSLLPSLPSQGEGD--------SHPLS- 63
sp|P21805|ANFC_CHICK        --------------------------------------------------
tr|A9CDT6|A9CDT6_CHICK      ----------------SLQSLSMLLDEE----------------------L 39
sp|P20968|ANFC_RANCA        ----------------SLQNLSRLLEDN----------------------F 41
sp|P55208|ANFC_TRISC        --------------DDSLQTLSRLLEDE----------------------Y 40
sp|P23259|ANFC_SCYCA        --------------DDSLQTLSRLLEDE----------------------Y 19
sp|P41319|ANFC_SQUAC        --------------DDSLQVLSRLLEDE----------------------Y 40
tr|Q2MH72|Q2MH72_9CHON      --------------DDSLQALTRLLEDE----------------------Y 40
tr|Q2MH73|Q2MH73_9CHON      --------------DDSLQALTRLLEDE----------------------Y 40
tr|Q2MH71|Q2MH71_9CHON      --------------DDSLQALTRLLEDE----------------------Y 40
tr|Q2MH74|Q2MH74_DASAK      --------------DDSLQALTRLLEDE----------------------Y 40
tr|Q2PF87|Q2PF87_CALMI      --------------VDSLQTLSRLLEDE----------------------Y 43
sp|Q800I8|ANFC3_ORYLA       --------------ELQNLERLL--------------------------- 32
tr|Q4ADV1|Q4ADV1_ORYLA      --------------ELQNLERLL--------------------------- 32
sp|Q805D4|ANFC3_TAKRU       --------------DLQILEPPLSSLEEQEEMQEEVQEKVQEQQEEVQ 59
tr|C0H7B0|C0H7B0_SALSA      --------------NLQSLKQLLEEE------------------------SH 41
tr|C1BWD1|C1BWD1_ESOLU      --------------NLQSLKEFLEE-------------------------SN 38
tr|D2KXA3|D2KXA3_ANGJA      --------------SLQSLKELLEE-------------------------SN 39
tr|B3DJJ2|B3DJJ2_DANRE      --------------SLQSLRQLLDEE------------------------VN 39
tr|Q1XGY8|Q1XGY8_9ACTI      --------------SLQSFAQLLEDE-------------------------SN 39
sp|Q8AXR2|ANFC2_ONCMY       --------------AIQFVEQFLDR-------------------------YN 43
sp|Q8AXR3|ANFC1_ONCMY       --------------AIQFVEQFLDR-------------------------YN 43
tr|C1BKS8|C1BKS8_OSMMO      --------------GLQFVEQFLER-------------------------CT 43
tr|Q805E7|Q805E7_OREMO      --------------AVQFVEQFLER-------------------------YN 43
tr|C3KH23|C3KH23_ANOFI      --------------AVQFMEQFLER-------------------------YN 43
sp|Q8AYR6|ANFC1_ORYLA       --------------AVQFVEQFLDR-------------------------YN 43
sp|Q805D6|ANFC1_TAKRU       --------------AAQFMEQFLES-------------------------YN 43
sp|P18145|ANFC_ANGJA        --------------AIQFVEQFLEH-------------------------YN 43
tr|Q1XGY9|Q1XGY9_9ACTI      --------------LQFLSTLLEKE-------------------------YG 51
tr|A9CDT5|A9CDT5_CHICK      --------------LQVLLSQLLPS-------------------------DS 44
```

FIG. 4E
Multiple Alignment of C-Type Natriuretic Peptides from Various Species

```
sp|Q8AYR5|ANFC2_ORYLA    APPTSNDS--TEGSSGSPEPP-------------------TPSEAPVLIH--  76
sp|Q805D5|ANFC2_TAKRU    TPVNTDDI---AELLPRRPGPPR-------------SFGASPGALRGLTR--  81
sp|Q76KW6|ANFC_ACITR     DAGAADGSSGEEAAISQRAPPS--------------IRALHPRSGRLGLRDD  95
sp|Q61839|ANFC_MOUSE     GNQKKGDKTPGSGGANLKGDRS----------------------RLLRDLR  76
tr|Q544K5|Q544K5_MOUSE   GNQKKGDKTPGSGGANLKGDRS----------------------RLLRDLR  76
tr|Q8VHG9|Q8VHG9_NOTAL   GNQKKGDKTPGGGGANLKGDRSRLLKGDKTPGGGGANLKGDRSRLLRDLR  97
sp|P55207|ANFC_RAT       GNQKKGDKTPGGGGANLKGDRS----------------------RLLRDLR  76
sp|P55206|ANFC_BOVIN     GGGQKKGDKTPGGGGANLKDDRS---------------------RLLRDLR  76
sp|P56283|ANFC_SHEEP     GGGQKKGDKTPGGGGANLKDRS----------------------RLLRDLR  76
sp|P18104|ANFC_PIG       GGGQKKGDKTPGGGGANLKGDRS---------------------RLLRDLR  76
sp|P23582|ANFC_HUMAN     GGGKKKGDKAPGGGGANLKGDRS---------------------RLLRDLR  76
sp|P84715|ANF39_ORNAN    GGGKKKGDKEP-------KGDRP---------------------RLLRELR  68
tr|Q9QZ96|Q9QZ96_CAVPO   -------------------------------------------------- 
sp|Q80017|ANFC4_ORYLA    ENENRLDDVRSRM-------------------------------RLLRDLR  68
sp|Q805D3|ANFC4_TAKRU    EKERRLDAVRSRL-------------------------------RLLRDLR  68
tr|C1BXI5|C1BXI5_ESOLU   ERERRLDTVRSRV-------------------------------RLLRDLR  68
tr|D2KXA5|D2KXA5_ANGJA   ERERNLESARS---------------------------------RLLRDLR  66
tr|Q1XGY7|Q1XGY7_9ACTI   EQESGSERLRSRA-------------------------------RLLRDLR  68
sp|P40756|ANFD_RANCA     ERGERSIDPKTRA-------------------------------RLLRDIR  68
sp|P0C7P5|BNP_TRIFL      ----------------PAAPHRLPKSKG-------ASATS-AASRPMRDLR 130
sp|P0C7P6|BNP_TRIGA      ----------------PAAPQRLPKRKG-------ASATS-AASRSMRDLR 147
sp|Q6LEM5|BNP1_BOTJA     VPSAGAEVGRSGSK-APAAPHRLSKSKG-------AAAT-----RPMRDLR 193
sp|Q9PW56|BNP2_BOTJA     VPSAGAEVGRSGSK-APAAPHRLSKSKG-------AAATS-AASRPMRDLR 201
sp|P68515|BNP_BOTIN      VPSAGAEVGRSGSK-APAAPHRLSKSKG-------AAATS-AASRPMRDLR 201
sp|Q90Y12|BNP_CRODU      TPPAGPDGGPRGSKAAAAAPQRLSKSKG-------ASATS-AASR---DLR 118
sp|Q2PE51|BNP_CRODO      TPPAGPDGGPRGSKAAAAAPQRLSKSKG-------ASATS-AASR---DLR 118
sp|B0VXV8|BNP_SISCA      TPPAGPDVGPRGSK-AAAAPQRLSKSKG-------ASATS-TASRPMRDLR 137
sp|Q2TF49|BNP_LACMU      TPPAGPDVGPRGSK-APAAPHRLPKSKG-------ASATS-AASRPMRDLR 178
sp|P01021|BNP_AGKBA      PAAAGADGGRSGSK-APAALHRLSKSKG-------ASATSASASRPMRDLR 199
sp|Q09GK2|VNP_PHIGL      PAAGGGGGGRSGSKAANAAPTAPKSKGG-----AAAAAAAARLMRDLR 100
tr|D1MZV3|D1MZV3_RHATT   PAAGGGGG--RSGSKTANAAPTAPKSKG--------AAASAASRLLRDLR  99
tr|Q7T1M4|Q7T1M4_BOTUR   VPSAGAEGRAQRLEGARCTPSAVEEQRGG------GDLGGVAADAGLAPRR 155
tr|Q402A2|Q402A2_PETMA   VTATGGVSGGVSGGVLGGIPWVGPRGHQ----------------RPSRGLA  65
tr|Q402A3|Q402A3_LAMJA   ATVTR-HGGGGGGGGGDDGISWELPQGGPG--------------PPRSSRGLA 97
tr|Q402A1|Q402A1_9PETR   -----------AEGG------PWERGSGPQ--------------RSSRGTG  83
sp|P21805|ANFC_CHICK     --------------------------------------------------
tr|A9CDT6|A9CDT6_CHICK   QHPLVSEERDREQDGSIPVGAF-----DQEDAEFQWTRNTRD--------  76
sp|P20968|ANFC_RANCA     ERSFGSDEADQQL---VPTDSL------DQLDPELQWNKNRLE-------  75
sp|P55208|ANFC_TRISC     GHYLPSDELNNEAQEMSPAASLPEFNADQSDLELPWDRESRE--------  82
sp|P23259|ANFC_SCYCA     GHYLPSDELNNEAEEMSPAASLPELNADQSDLELPWNERESRE-------  61
sp|P41319|ANFC_SQUAC     GHFN-SEELNNEAQEISPAASLPDLNTDQSDLELPWDRESRE--------  81
tr|Q2MH72|Q2MH72_9CHON   GQYFTIEDLNNEAPFIPPAASLPDLNTDQSDLDLSWDRESRE--------  82
tr|Q2MH73|Q2MH73_9CHON   GQYFTIEDLNNEAPEIPAASLPDLNTDQSDLDLSWDRESRE---------  82
tr|Q2MH71|Q2MH71_9CHON   GQYFTSEDLNNEAPEIPPAASLPDLNTDQPDPDLSWDRESRE--------  82
tr|Q2MH74|Q2MH74_DASAK   GQYFTSEDLNNEAPEMSPAASLPDLNTEQSETDLPWDRESRE--------  82
tr|Q2PF87|Q2PF87_CALMI   GPYLSSEDSDMEAEEASRAGTLRDLNLDQADMDLLWDRDARD--------  85
sp|Q80018|ANFC3_ORYLA    ---QDQLSSTERPEE---DRLD-----RTREEPQLGG-------------  58
tr|Q4ADV1|Q4ADV1_ORYLA   ---QDQLSSTERPEE---DRLD-----RTREEPQLGG-------------  58
sp|Q805D4|ANFC3_TAKRU    EKVQEQQEEVQQQEEVQEQQE------EQQEEVQERGRGTGDVLLRAQLD 104
tr|C0H7B0|C0H7B0_SALSA   VPYYASDEMGVDGKDLNTEN---------IAEEVPPWDSEDAR-------  75
tr|C1BWD1|C1BWD1_ESOLU   VPYYGSEESEVDDKDLNTEKEA------FTGEVVQPWLTEDR--------  74
tr|D2KXA3|D2KXA3_ANGJA   APYLDSEEAEVQCKEMNAENAA------FTKASLHSWDPNSR--------  75
tr|B3DJJ2|B3DJJ2_DANRE   KPFEESQESVMEQKDATAEKSA------LDERAEQLWESDAR--------  75
tr|Q1XGY8|Q1XGY8_9ACTI   HPYVDSDDDTRGGLDVSAEIAT-----DDSEADIPWNHNFRDL-------  77
sp|Q8AXR2|ANFC2_ONCMY    DLT--LDDLENLVSSQPEEPSS-------------AFTSGVKIAEYPKW  77
sp|Q8AXR3|ANFC1_ONCMY    DLT--LDDLENLVSSQPEEPSS-------------AFTSGVKVAEYPKW  77
tr|C1BKS8|C1BKS8_OSMMO   DLLN-LDDLENAGSNQPEEPS--------------DYANGVKVAEYPKW  77
tr|Q805E7|Q805E7_OREMO   DLLT-LDDLENMLNSQAEEQS--------------TLSSGSKAVEYPKW  77
tr|C3KH23|C3KH23_ANOFI   DLLT-LDDLENLLNSQPEEQS--------------TFSSGVKAAEYPKW  77
sp|Q8AYR6|ANFC1_ORYLA    DLLT-LDDLENLLNIQPEEQS--------------TLSSGVKTAEYPKW  77
sp|Q805D6|ANFC1_TAKRU    DLLT-LDDLENMLNSHPEEQS--------------NLSS-SKADEYPKW  76
sp|P18145|ANFC_ANGJA     DLLN-IDDLENQTGDQLESPQ---------------PLSSGLKVAEYPKW  77
tr|Q1XGY9|Q1XGY9_9ACTI   NLQSGPVKIHNVSSEQYEDPQ---------------PWADVSSVSKEQIW  86
tr|A9CDT5|A9CDT5_CHICK   ESMPAEEDMKEGSSSEPQLLSP--------------PLPLLPSRAR----  76
```

FIG. 4F
Multiple Alignment of C-Type Natriuretic Peptides from Various Species

```
sp|Q8AYR5|ANFC2_ORYLA    --------GDRGTASQILRSFLRQRE------------KTRRWG---RKPMVAG- 107
sp|Q805D5|ANFC2_TAKRU    ------------GSEG-GSRFLLDFLQQQS------------KTTRRG---RSSMVGG- 111
sp|Q76KW6|ANFC_ACITR     LEAEPPAENKPRRRLLKDFMSSR------------RMFRGR---TKKMQQG- 131
sp|Q61839|ANFC_MOUSE     VDTKSR-----AAWARLLHEHPN----------------ARKYKG---GNKKGLS- 107
tr|Q544K5|Q544K5_MOUSE   VDTKSR----AAWARLLHEHPN----------------ARKYKG---GNKKGLS- 107
tr|Q8VHG9|Q8VHG9_NOTAL   VDTKSR----AAWARLLHEHPN----------------ARKNKG---GNKKGLS- 128
sp|P55207|ANFC_RAT       VDTKSR----AAWARLLHEHPN----------------ARKYKG---GNKKGLS- 107
sp|P55206|ANFC_BOVIN     VDTKSR----AAWTRLLHEHPN----------------ARKYKG---GNKKGLS- 107
sp|P55283|ANFC_SHEEP     VDTKSR----AAWTRLLHEHPN----------------ARKYKG---GNKKGLS- 107
sp|P18104|ANFC_PIG       VDTKSR----AAWARLLHEHPN----------------ARKYKG---GNKKGLS- 107
sp|P23582|ANFC_HUMAN     VDTKSR----AAWARLLQEHPN----------------ARKYKG---ANKKGLS- 107
sp|P84715|ANF39_ORNAN    LDTRSRGSRGVWTRLLHDHPN-------------PRKYKP---ANKKGLS- 102
tr|Q9QZ96|Q9QZ96_CAVPO   ---------------------N----------------ARKYKG---GNKKGLS- 14
sp|Q800I7|ANFC4_ORYLA    VDTRAR------GMWARLLNDQPA-------------SRRHKS---GSKKCGST 100
sp|Q805D3|ANFC4_TAKRU    MDTRAR---GVWARLLNDQPV-------------PRRHKT---GIKKGGS- 89
tr|C1BXI5|C1BXI5_ESOLU   MDTRAK---GMWARLLNDQPN-------------ARREKQ---NSKKGTV- 99
tr|D2KXA5|D2KXA5_ANGJA   LNTRAR---GMWSRIMNDQPA-------------SRKQKT---GVKKGAST 98
tr|Q1XGY7|Q1XGY7_9ACTI   LDIRAK---AAWARLLNDHPN-------------PRKSKC---INKKGLS- 99
sp|P40756|ANFD_RANCA     ADTRSR---AAWTRLLNEHPN-------------SRKIKG---INKKGTS- 99
sp|P0C7P5|BNP_TRIFL      TDGKQERQKWG--RMVQPDHHAAPGGGGGGGG-ARRMKG---LAKKAMG- 174
sp|P0C7P6|BNP_TRIGA      ADGKQARQKWG--RMVQPDHHAAPGGGGGGGGG-ARRLKG---LAKKAVG- 191
sp|Q6LEM5|BNP1_BOTJA     PDGKQARQNWG--RMAHKDHHAAACGGGGGGGG-ARRLKG---LAKKGAA- 237
sp|Q9PW56|BNP2_BOTJA     PDGKQARQNWG--RMVHRDHHAAVGGGGGGGGGG-ARRLKG---LAKKGAA- 246
sp|P68515|BNP_BOTIN      PDGKQARQNWG--RMVHKDHHAAVCGGGGGGGGG-ARRLKG---LAKKGAA- 246
sp|Q90Y12|BNP_CRODU      TDGKQARQNWG--RLVSPDHHSAAGGGCGGGGG-ARRLKG---LAKKRAG- 162
sp|Q2PE51|BNP_CRODO      TDGKQARQNWG--RLVSPDHHSAACGGCGGGGG-ARRLKG---LAKKRAG- 162
sp|B0VXV8|BNP_SISCA      TDGKQARQNWG--RMLNPDHHSAPGGGGGGGGGGGARRLKG---LAKKRAG- 182
sp|Q27J49|BNP_LACMU      TDGKQARQNWG--RMMNPDHHAVGGGG---GGGG-ARRLKG---LAKKRVG- 220
sp|P01021|BNP_AGKHA      TDGKQARQNWA--RMVNPDHHAVGGCCCGGGGGGARRLKG---LVKKGVA- 244
sp|Q09GK2|VNP_PHIOL      PDSKQARAAWG--RMVHPEHHAGCGGGGGGGGGASRRLKG---VAKKCLG- 145
tr|D1MZV3|D1MZV3_RHATT   PDGKQSRAAWG--RMVHPEHHAGGGGGGGGGG--SRRLKG---LFKKGLG- 142
tr|Q7T1M4|Q7T1M4_BOTJR   QAGAAELGPDGAPRPPRPPRSGRRAAAAAAAERGARRLKC---LAKKGAA- 202
tr|Q402A2|Q402A2_PETMA   EGGSQVSG-GVWQRLFNDFVSN-------------QRRFRG---RIKKGKG- 99
tr|Q402A3|Q402A3_LAMJA   EGGSQVSG-GVWQRLFNDFVSN-------------QRRFRG---RIKKGKG- 131
tr|Q402A1|Q402A1_9PETR   -GGSQVSG-EVWQRLFNDFVSN-------------QRRFRG---RIKKGKG- 116
sp|P21805|ANFC_CHICK     ----------------------------------------GLS- 3
tr|A9CDT6|A9CDT6_CHICK   QPASTSTADSDVQRILSDLLGL-------------PQRYQN---RSKKGLS- 111
sp|P20968|ANFC_RANCA     QGDSPHVNEMTLQQLLNDPVGT-------------SRRYRQ---RNKKGYS- 110
sp|P55208|ANFC_TRISC     IGGRPFRQEAVLARLLKDLSNN-------------PLRFRG---RSKKGPS- 117
sp|P23259|ANFC_SCYCA     IGGRPFRQEAVLARLLKDLSNN-------------PLRFRG---RSKKGPS- 96
sp|P41319|ANFC_SQUAC     IGGRSFRQEALLARLLQDLSNN-------------PLRFKG---RSKKGPS- 116
tr|Q2MH72|Q2MH72_9CHON   IASR------PILARILKDLSNN-------------PLRFRG---RSKKGPS- 112
tr|Q2MH73|Q2MH73_9CHON   IASR------PILARILKDLSNN-------------PLRFRG---RSKKGPS- 112
tr|Q2MH71|Q2MH71_9CHON   IASR------PILARILKDLSNN-------------PLRFRG---RSKKGPS- 112
tr|Q2MH74|Q2MH74_DASAK   IASR------PILARILKDLNKI-------------PLRFRG---RSKKGPS- 112
tr|Q2PF87|Q2PF87_CALMI   IGGRSFQHDGLLLRLLKDLTIS-------------PLRFNG---RSKKGPS- 120
sp|Q800I8|ANFC3_ORYLA    SSSREAADESALIRLFADLLRT-------------SKRSWG---RYKKGGM- 93
tr|Q4ADV1|Q4ADV1_ORYLA   SSSREAADESALIRLFADLLRT-------------SKRSWG---RYKKGGM- 93
sp|Q805D4|ANFC3_TAKRU    SSTWALQKDDVLMRLFKDLLRT-------------SKRSRS---RYKKGGL- 139
tr|C0H7B0|C0H7B0_SALSA   -NSALTGKEDVIARLLNDIMTT-------------PKRSWS---RFKKGGL- 109
tr|C1BWD1|C1BWD1_ESOLU   --SALTGKENAVARLLSDIMTT-------------PKRSWG---RFKKGGM- 107
tr|D2KXA3|D2KXA3_ANGJA   -DAALSSNENALVRLLNDILSS-------------SKRSWS---RFKKGGL- 109
tr|B3DJJ2|B3DJJ2_DANRE   -NSALAGKYGMFERLLGDLLST-------------SKRSWS---RFKKGDL- 109
tr|Q1XGY8|Q1XGY8_9ACTI   -QHRQAAHSSRMLRLLKDILTS-------------SGRSWD---REKKSGL- 111
sp|Q8AXR2|ANFC2_ONCMY    ADIP-AQGDSTWLRLLKGTLAN-----------QKRAVT--DRSRRGWN- 112
sp|Q8AXR3|ANFC1_ONCMY    ADIP-AQGDSTWLRLLKGTLAN------------QKRAVM-DRSRRGWN- 112
tr|C1BKS8|C1BKS8_OSMMO   ADLPAAQEDSAWLRLLKAALAN------------QKRAEP-DRSRRAWN- 113
tr|Q805E7|Q805E7_OREMO   ADAQTQPE-TPWLRLLKGALAN------------QKRAEP-DRSRRGWN- 112
tr|C3KH23|C3KH23_ANOFI   ADAQIQAE-TPWLRLLKGAVAN------------QKRAEP-DRSRRGWN- 112
sp|Q8AYR6|ANFC1_ORYLA    ADLQTQPE-TPWFRLLKGALTN------------QKRAEP-DRSRRGWN- 112
sp|Q805D6|ANFC1_TAKRU    AEAD--------TPWFRLLKGALAN------------QKRAEP-DRSRRGWN- 107
sp|P18145|BNFC_ANGJA     VDVPSQKD-KTWFRLLRGALAN------------RKRALP-DRAKRGWN- 112
tr|Q1XGY9|Q1XGY9_9ACTI   GDEPPANE-KALYLLLRRAAAN-----------RIWISA-DRVKKAWS- 121
tr|A9CDT5|A9CDT5_CHICK   ---------AAHPLLWRKALAS------------RKRALSGDWAWKAVP- 104
```

FIG. 4G
Multiple Alignment of C-Type Natriuretic Peptides from Various Species

```
sp:Q8AYR5|ANFC2_ORYLA    ----GGCFGMKMDRIGSISGLGC- 126  (SEQ ID NO: 31)
sp:Q805D5|ANFC2_TAKRU    ----RGCFGMKIDRIGSISGLGC- 130  (SEQ ID NO: 32)
sp:Q76KW6|ANFC_ACIIR     ----RGCFGMKLDRIGSMSGLGC- 150  (SEQ ID NO: 33)
sp:Q61839|ANFC_MOUSE     ----KGCFGLKLDRIGSMSGLGC- 126  (SEQ ID NO: 34)
tr:Q544K5|Q544K5_MOUSE   -----KGCFGLKLDRIGSMSGLGC- 126 (SEQ ID NO: 35)
tr:Q8VHG9|Q8VHG9_NOTAL   ----KGCFGLKLDRIGSMSGLGC- 147  (SEQ ID NO: 36)
sp:P55207|ANFC_RAT       ----KGCFGLKLDRIGSMSGLGC- 126  (SEQ ID NO: 37)
sp:P55206|ANFC_BOVIN     ----KGCFGLKLDRIGSMSGLGC- 126  (SEQ ID NO: 38)
sp:P56283|ANFC_SHEEP     ----KGCFGLKLDRIGSMSGLGC- 126  (SEQ ID NO: 39)
sp:P18104|ANFC_PIG       -----KGCFGLKLDRIGSMSGLGC- 126 (SEQ ID NO: 40)
sp:P23582|ANFC_HUMAN     ----KGCFGLKLDRIGSMSGLGC- 126  (SEQ ID NO: 41)
sp:P84715|ANF39_ORNAN    ----KGCFGLKLDRIGSTSGLGC- 121  (SEQ ID NO: 42)
tr:Q9Q296|Q9Q296_CAVPO   ------KGCFGLKLDRIGSMSGLGC- 33 (SEQ ID NO: 43)
sp:Q800I7|ANFC4_ORYLA    -SRSGCFGHKMDRIGTISGMGC- 121   (SEQ ID NO: 44)
sp:Q805D3|ANFC4_TAKRU    -SRSGCFGHKMDRIGTISGMGC- 120   (SEQ ID NO: 45)
tr:C1BXI5|C1BXI5_ESOLU   -PRSGCFGQKLDRIGTLSGMGCN 121   (SEQ ID NO: 46)
tr:D2KXA5|D2KXA5_ANGJA   PARGGCFGHKLDRISTLSGMGC- 120   (SEQ ID NO: 47)
tr:Q1XGY7|Q1XGY7_9ACTI   -----KGCFGLKLDRIGSMSGLGC- 118 (SEQ ID NO: 48)
sp:P40756|ANFD_RANCA     ----KGCFGLKLDRIGAMSGLGC- 118  (SEQ ID NO: 49)
sp:P0C7P5|BNP_TRIFL      ----KGCFGHKLDRIGSTSGLGC- 193  (SEQ ID NO: 50)
sp:P0C7P6|BNP_TRIGA      ----KGCFGLPLDRIGSMSGMGC- 210  (SEQ ID NO: 51)
sp:Q6LEM5|BNP1_BOTJA     ----KGCFGLKLDRIGTMSGLGC- 256  (SEQ ID NO: 52)
sp:Q9PW56|BNP2_BOTJA     -----KGCFGLKVDRIGTMSGLGC- 265 (SEQ ID NO: 53)
sp:P68515|BNP_BOTIN      ----KGCFGLKLDRIGTMSGLGC- 265  (SEQ ID NO: 54)
sp:Q90Y12|BNP_CRODU      ----NGCFGLKLDRIGSMSGLGC- 181  (SEQ ID NO: 55)
sp:Q2PE51|BNP_CRODO      -----NGCFGLKLDRIGSMSGLGC- 181 (SEQ ID NO: 56)
sp:B0VXV8|BNP_SISCA      ----SGCFGLKLDRIGSMSGLGC- 201  (SEQ ID NO: 57)
sp:Q27J49|BNP_LACMU      ----DGCFGLKLDRIGSMSGLGC- 239  (SEQ ID NO: 58)
sp:P01021|BNP_AGKHA      ------KGCFGLKLDRIGTMSGLGC- 263 (SEQ ID NO: 59)
sp:Q09GK2|VNP_PHIOL      ----KGCFGLKLDRIGSMSGLGC- 164  (SEQ ID NO: 60)
tr:D1MZV3|D1MZV3_RHATT   ----SGCFGLKLDRIGSMSGLGC- 161  (SEQ ID NO: 61)
tr:Q7T1M4|Q7T1M4_BOTJR   ----KGCFGLKLDRIGTMSGLGC- 221  (SEQ ID NO: 62)
tr:Q402A2|Q402A2_PETMA   ------CFGVKLDRIGSMSGLGC- 116  (SEQ ID NO: 63)
tr:Q402A3|Q402A3_LAMJA   --------CFGVKLDRIGSMSGLGC- 148 (SEQ ID NO: 64)
tr:Q402A1|Q402A1_9PETR   ------CFGVKLDRIGSMSGLGC- 133  (SEQ ID NO: 65)
sp:P21805|ANFC_CHICK     ----RSCFGVKLDRIGSMSGLGC- 22   (SEQ ID NO: 66)
tr:A9CDT6|A9CDT6_CHICK   ----RSCFGVKLDRIGSMSGLGC- 130  (SEQ ID NO: 67)
sp:P20968|ANFC_RANCA     ----RGCFGVKLDRIGAFSGLGC- 129  (SEQ ID NO: 68)
sp:P55208|ANFC_TRISC     -----RGCFGVKLDRIGAMSGLGC- 136 (SEQ ID NO: 69)
sp:P23259|ANFC_SCYCA     ----RGCFGVKLDRIGAMSGLGC- 115  (SEQ ID NO: 70)
sp:P41319|ANFC_SQUAC     ----RSCFGVKLDRIGAMSGLGC- 135  (SEQ ID NO: 71)
tr:Q2MH72|Q2MH72_9CHON   ------RGCFGVKLDRIGAMSGLGC- 131 (SEQ ID NO: 72)
tr:Q2MH73|Q2MH73_9CHON   ----RGCFGVKLDRIGAMSGLGC- 131  (SEQ ID NO: 73)
tr:Q2MH71|Q2MH71_9CHON   ----RGCFGVKLDRIGAMSGLGC- 131  (SEQ ID NO: 74)
tr:Q2MH74|Q2MH74_DASAK   ----RGCFGVKLDRIGAMSGLGC- 131  (SEQ ID NO: 75)
tr:Q2PF87|Q2PF87_CALMI   ----RGCFGVKLDRIGAMSGLGC- 139  (SEQ ID NO: 76)
sp:Q80018|ANFC3_ORYLA    -----RSCFGVRLERIGSFSGLGC- 112 (SEQ ID NO: 77)
tr:Q4ADV1|Q4ADV1_ORYLA   ----RSCFGVRLERIGSFSGLGC- 112  (SEQ ID NO: 78)
sp:Q805D4|ANFC3_TAKRU    ----RSCFGVRLARIGSFSGLGC- 158  (SEQ ID NO: 79)
tr:C0H7B0|C0H7B0_SALSA   ----RSCFGVRLERIGSFSGLGC- 128  (SEQ ID NO: 80)
tr:C1BWD1|C1BWD1_ESOLU   ----RSCFGVRLERIGSFSGLGC- 126  (SEQ ID NO: 81)
tr:D2KXA3|D2KXA3_ANGJA   ----RSCFGVRLERIGSFSGLGC- 128  (SEQ ID NO: 82)
tr:B3DJJ2|B3DJJ2_DANRE   ----RSCFGVRLERIGSFSGLGC- 128  (SEQ ID NO: 83)
tr:Q1XGY8|Q1XGY8_9ACTI   ----RSCFGVRLDRIGSMSGLGC- 130  (SEQ ID NO: 84)
sp:Q8AXR2|ANFC2_ONCMY    -----RGCFGLKLDRIGSMSGLGC- 131 (SEQ ID NO: 85)
sp:Q8AXR3|ANFC1_ONCMY    ----RSCFGLKLDRIGSMSGLGC- 131  (SEQ ID NO: 86)
tr:C1BKS8|C1BKS8_OSMMO   ----RGCFGLKLDRIGSMSGLGC- 132  (SEQ ID NO: 87)
tr:Q805E7|Q805E7_OREMO   ----RGCFGLKLDRIGSMSGLGC- 131  (SEQ ID NO: 88)
tr:C3KH23|C3KH23_ANOFI   ----RGCFGLKLDRIGSMSGLGC- 131  (SEQ ID NO: 89)
sp:Q8AYR6|ANFC1_ORYLA    ----RGCFGLKLDRIGSMSGLGC- 131  (SEQ ID NO: 90)
sp:Q805D6|ANFC1_TAKRU    ----RGCFGLKLDRIGSMSGLGC- 126  (SEQ ID NO: 91)
sp:P18145|ANFC_ANGJA     ----RGCFGLKLDRIGSMSGLGC- 131  (SEQ ID NO: 92)
tr:Q1XGY9|Q1XGY9_9ACTI   ----KGCFGLKLDRIGSISGLGC- 140  (SEQ ID NO: 93)
tr:A9CDT5|A9CDT5_CHICK   ----RGCFGLKMDRIGAFSGLGC- 123  (SEQ ID NO: 94)
                             ***  : **.: **:**

CONSENSUS SEQUENCE           CFGXXXXRIXXXSGXGC   (SEQ ID NO: 95)
```

Schematic Structure of Natriuretic Peptide

FIG. 6
Exemplary Fc Sequence (IgG-1)

DKTHTCPPCPAPELLGGPSVFLFPPKPKDTLMISRTPEVTCVVVDVSHEDPEVKFNWYVDGVEV
HNAKTKPREEQYNSTYRVVSVLTVLHQDWLNGKEYKCKVSNKALPAPIEKTISKAKGQPREPQV
YTLPPSREEMTKNQVSLTCLVKGFYPSDIAVEWESNGQPENNYKTTPPVLDSDGSFFLYSKLTV
DKSRWQQGNVFSCSVMHEALHNHYTQKSLSLSPGK (SEQ ID NO: 401)

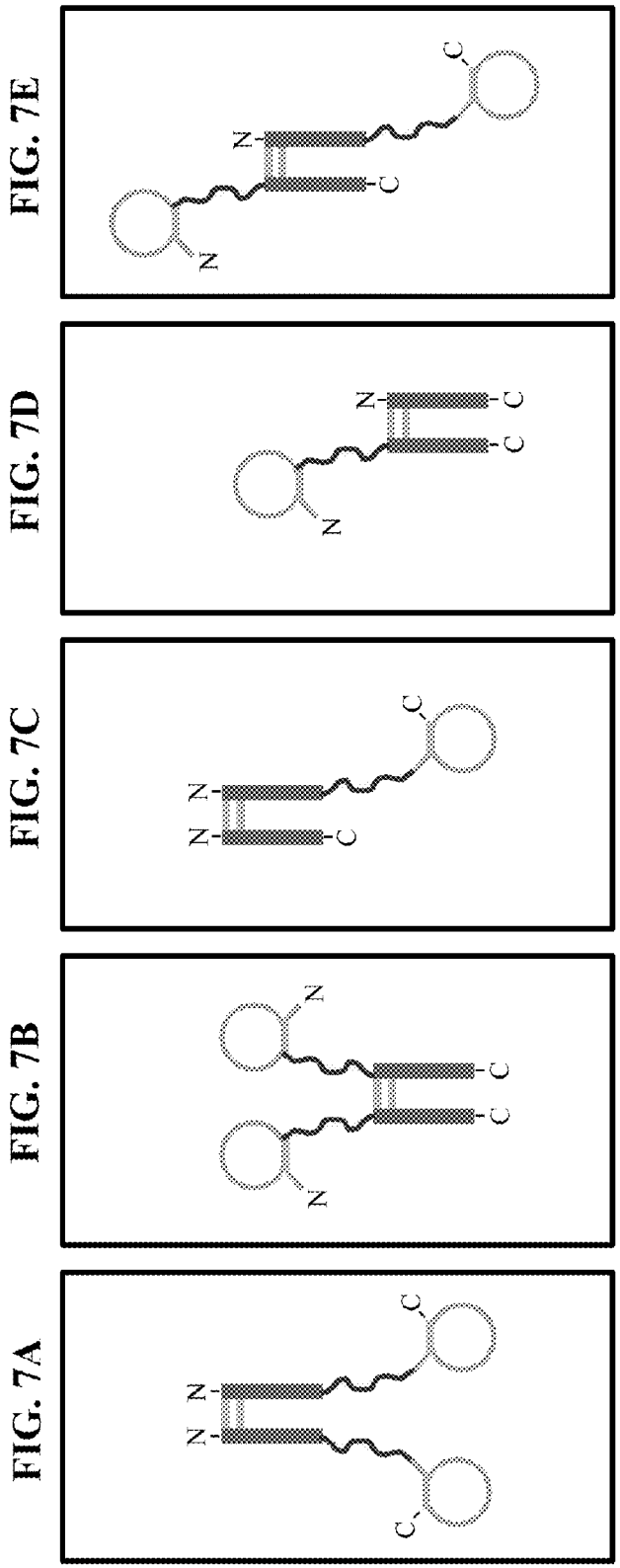

FIG. 8A

NC2st Protein Sequence (With Signal Sequence)

Sequence:
```
         10         20         30         40         50         60
MGVHECPAWL WLLLSLLSLW PGAYAAASWSH PQFEQSGGGG GENLYFQGGGD KTHTCPPCPA 70         80         90        100        110        120
PELLGGPSVF LFPPKPKDTL MISRTPEVTC VVVDVSHEDP EVKFNWYVDG VEVHNAKTKP 130        140        150        160        170        180
REEQYNSTYR VVSVLTVLHQ DWLNGKEYKC KVSNKALPAP IEKTISKAKG QPREPQVYTL 190        200        210        220        230        240
PPSREEMTKN QVSLTCLVKG FYPSDIAVEW ESNGQPENNY KTTPPVLDSD GSFFLYSKLT 250        260        270        280        290        300
VDKSRWQQGN VFSCSVMHEA LHNHYTQKSL SLSPGKGGGG SGGGGSGGGG SGGGSHHHHH

310
LKMDRIGSMS GLGC (SEQ ID NO: 501)
```

Number of amino acids: 314
Molecular weight of monomer: 34053.5

1-25 = Signal peptide
26-27 = Linker
28-35 = Strep-tag II
36-41 = Linker
42-47 = Tobacco etch virus protease cleavage sequence
48-49 = Linker
50-276 = Fc domain of human IgG1
277-292 = Glycine-rich linker
293-314 = C-type natriuretic peptide

FIG. 8B

NC2st Protein Sequence (Without Signal Sequence)

NC2st (w/o sig. seq.) ASWSHPQFEQSGGGGENLYFQGGDKTHTCPPCPAPELLGGPSVFLFPPKPKDTLMISRTPEVTCVVVDVSHE
DPEVKFNWYVDGVEVHNAKTKPREEQYNSTYRVVSVLTVLHQDWLNGKEYKCKVSNKALPAPIEKTISKAKGQ
PREPQVYTLPPSREEMTKNQVSLTCLVKGFYPSDIAVEWESNGQPENNYKTTPPVLDSDGSFFLYSKLTVDKS
RWQQGNVFSCSVMHEALHNHYTQKSLSLSPGKGGGGSGGGGSGGGGSGLSKCCTGITKIDR GSMSGLGC (SEQ ID NO: 502)

FIG. 8C

NC2st DNA Sequence

```
ATGGGCGTGCACGAGTGTCCTGCTGTGGCCTGGCCTGCTGCTGTCTCTGTGGCCTGGCCCTACGCGCCTCTTGGAGC
CACCCCCAGTTTGAGCAGTCTGGCGGCGGAGGAGGCGAGAACCTGTACTTTCAGGGCGGCGACAAGATCTCCCCTTGT
CCTGCCCCTGAGCTGCTGGGCGGACCCAGCCTGTTCCTGTTCCCCCCAAAGCCCAAGGACACCCTGATGATCAGCCGGACCCCCGAA
GTGACCTGCGTGGTGGTGGACGTGTCCCACGAGGACCCTGAAGTGAAGTTCAATTGGTACGTGGACGGCGTGGAGGTGCACAACGCC
AAGACCAAGCCCCGGGAGGAACAGTACAACAGCACCTACCGGGTGGTGTCCGTGCTGACCGTGCTGCACCAGGACTGGCTGAACGGC
AAGGAGTACAAGTGCAAGGTCTCCAACAAGGCCCTGCCCGCCCCCATCGAGAAAACCATCAGCAAGGCCAAGGGCCAGCCCAGAGAA
CCCCAGGTGTACACCCTGCCCCCCAGCCGGGAGGAAATGACCAAGAACCAGGTGTCCCTGACCTGCCTGGTGAAGGGCTTCTACCCC
AGCGATATCGCCGTGGAGTGGGAGAGCAACGGCCAGCCTGAGAACAACTACAAGACCACCCCCTGTGCTGGACAGCGACGGAAGC
TTCTTCCTGTACTCCAAACTGACCGTGGACAAGAGCCGGTGGCAGCAGGGCAACGTGTTCAGCTGCAGCGTGATGCACGAGGCCCTG
CACAACCACTACACCCAGAAGTCCCTGTCCCTGAGCCTGGGCAAGTGAGGCGGAAGTGGAGGCGGAGGAAGCGGGGAGGCGGA
AGCGGCGGACTGAGCTGCTTCGGCCTGAAGCTGGACCGGATCGGCCATGAGCGCGGCCTGGGCGCTGA (SEQ ID NO:
801)
```

Results of PK Study Using NC2st

Dose-Response Assay: NPR-B Whole Cell cGMP Production

Dose Regimen Simulation for NC2st

Efficacy Study in ACH Mice: Crown-Rump Length

Efficacy Study in ACH Mice: Tibia Length

Efficacy Study in ACH Mice: Femur Length

Efficacy Study in ACH Mice: Neck-Anal Length

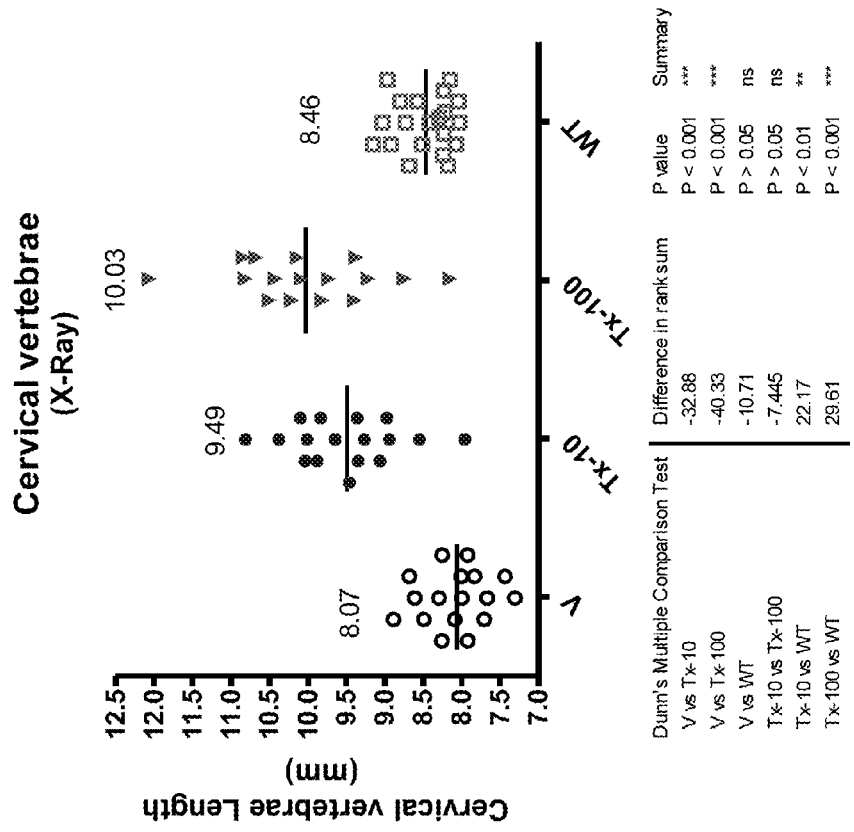
FIG. 12E Efficacy Study in ACH Mice: Cervical Vertebrae Length

Efficacy Study in ACH Mice: Thoracic Vertebrae Length

Efficacy Study in ACH Mice: Lumbar Vertebrae Length

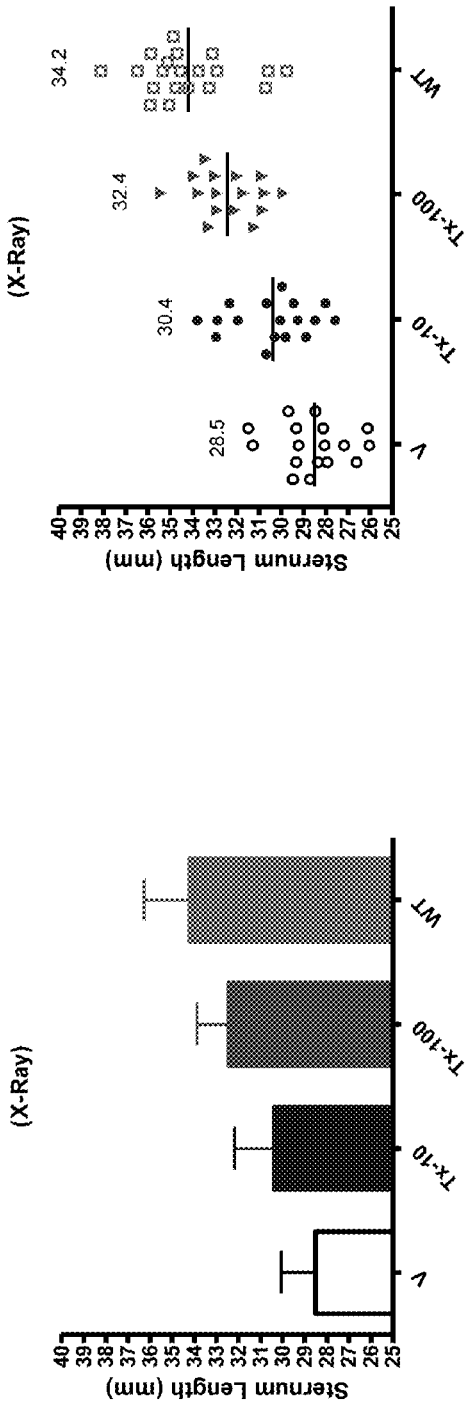
FIG. 12H Efficacy Study in ACH Mice: Sternum Length

Active Concentrations of NC2st Present in Blood Samples of Treated Mice

Active Concentrations of NC2st Present in Blood Samples of Treated Mice

FIG. 15A
NC2B Protein Sequences

NC2B (w/sig. seq.)  MGVHECPAWLWLLLSLLSLWPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGKGGGGSGGGGSGGGGSGGGGSGTISKCFCFIKIDRIGSMSGIGC
(SEQ ID NO: 503)

NC2B (w/o sig. seq.)  DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
SLSLSPGKGGGGSGGGGSGGGGSGGGGSGTISKCFCFIKIDRIGSMSGIGC (SEQ ID NO: 504)

D10-NC2 (w/sig. seq.)  MGVHECPAWLWLLLSLLSLWPGAYADDDDDDDDDDKTHTCPPCPAPELLGGPSVFLFPPKPKDTLMISRTPE
VTCVVVDVSHEDPEVKFNWYVDGVEVHNAKTKPREEQYNSTYRVVSVLTVLHQDWLNGKEYKCKVSNKALPAP
IEKTISKAKGQPREPQVYTLPPSREEMTKNQVSLTCLVKGFYPSDIAVEWESNGQPENNYKTTPPVLDSDGSF
FLYSKLTVDKSRWQQGNVFSCSVMHEALHNHYTQKSLSLSPGKGGGGSGGGGSGGGGSGGGGSGTISKCFCFIKIDR
IGSMSGIGC (SEQ ID NO: 607)

D10-NC2 (w/o sig. seq.)  DDDDDDDDDDKTHTCPPCPAPELLGGPSVFLFPPKPKDTLMISRTPEVTCVVVDVSHEDPEVKFNWYVDGVE
VHNAKTKPREEQYNSTYRVVSVLTVLHQDWLNGKEYKCKVSNKALPAPIEKTISKAKGQPREPQVYTLPPSRE
EMTKNQVSLTCLVKGFYPSDIAVEWESNGQPENNYKTTPPVLDSDGSFFLYSKLTVDKSRWQQGNVFSCSVMH
EALHNHYTQKSLSLSPGKGGGGSGGGGSGGGGSGGGGSGTISKCFCFIKIDRIGSMSGIGC (SEQ ID NO: 608)

FIG. 15B

NC2B DNA Sequence

```
ATGGGCCGTGCACGAGTGTCCTGCCTGGCTGTGCTGCTGGCCTGCTGTCCTGTGGCCTGGCCTACGCCGACAAGACCCAC
ACCTGTCCCCCTTGTCCTGCCCCTGAGCTGCTGGGCGGACCCAGCGTGTTCCTGTTCCCCCAAAGCCACCCTGATGATC
AGCCGGACCCCCGAAGTGACCGGGTGGGTGGTGGAGGAACCCTGAAGTGAAGTTCAATTGGTACGTGGACGGCGTG
GAGGTGCACAACGCCAAGACCAAGCCACGTGTACACAGCACCTACCGGGTGGTGTCCGTGCTGACCGTGCTGCACCAG
GACTGGCTGAACGGCAAGAGTACAAGTGCAAGGTCTCCAACAAGGCCCTGCCTGCCCCCATCGAGAAAACCATCAGCAAGGCCAAG
GGCCAGCCCAGAGAACCCCAGCGATATCGCCGTGAGTGGGAGAGCAAGGCCAGCCTGAGAACAACTACAAGACCACCCCCTGTCTG
AAGGGCTTCTACCCCAGCGATATCGCCGTGGAGTGGGAGAGCAATGACCTGAGAACAACTACAAGACCACCCCCTGTCTG
GACAGCGACGGCAGCTTCTTCCTGTACTCCAAACTGACCGTGGACAAGAGCCGGTGGCAGCAGGGCAACGTGTTCAGCTGCAGCGTG
ATGCACGAGGCCCTGCACAACCACTACACCCAGAAGTCCCTGAGCCTGTCTCCCTGAAGCTGCTTCGGCCTGCTGAGCATGGGAAGA
AGCGGGGAGGCCCTGAGCGGGGACTGAGCAAGGGCGAGACCGGGATCGGCCAGCTGGGACCTGGAAGCTGGACCATGAGCCGGCGCGCCTGGGCTGC
TGA (SEQ ID NO: 802)
```

FIG. 16A

NC2B-22, NC2B-28, and NC2B-34 Sequences

NC2B-22
(w/sig. seq.)

MGVHECPAWLWLLLSLLSLWPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSGSFFLYSKLTVDK
SRWQQGNVFSCSVMHEALHNHYTQKSLSLSPGK*GGGGSGGGGSGGGGSGGGGSGIISKCFGIISMSGISC* (SEQ ID NO: 505)

NC2B-22
(w/o sig. seq.)

DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSGSFFLYSKLTVDK*GGGGSGGGGSGGGGSGGGGSGIISK*
*CFGIISMSGISC* (SEQ ID NO: 506)

NC2B-28
(w/sig. seq.)

MGVHECPAWLWLLLSLLSLWPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSGSFFLYSKLTVDK
SRWQQGNVFSCSVMHEALHNHYTQKSLSLSPGK*GGGGSGGGGSGGGGSGGGGSKIDRIGSMSGISC* (SEQ ID NO:
508)

NC2B-28
(w/o sig. seq.)

DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSGSFFLYSKLTVDKSRWQQGNVFSCSVMHEALHNHYTQK
SLSLSPGK*GGGGSGGGGSGGGGSGGGGSKIDRIGSMSGISC* (SEQ ID NO: 509)

NC2B-34
(w/sig. seq.)

MGVHECPAWLWLLLSLLSLWPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSGSFFLYSKLTVDK
SRWQQGNVFSCSVMHEALHNHYTQKSLSLSPGK*GGGGSGGGGSGGGGSGGGGSGIISKCFGIISMSGISC*
*FGIIPIISMSGISC* (SEQ ID NO: 510)

NC2B-34
(w/o sig. seq.)

DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSGSFFLYSKLTVDKSRWQQGNVFSCSVMHEALHNHYTQK
SLSLSPGK*GGGGSGGGGSGGGGSGGGGSGIIPIISMSGISC* (SEQ ID
NO: 510)

FIG. 16B

NC2B-22 DNA Sequence

ATGGGGCGTGCACGAGTGTCCTGCCTGGCTGTGCTGCTGAGCCTGTCTCTGTGGCCTACGCCGACAAGACCCAC
ACCTGTCCCCCCTTGTCCTGCCCCTGCCCCTGAGCTGCTGGGGCGGGACCCAGCGTGTGTTCCCCCCAAAGCCCACCCTGATGATC
AGCCCGGACCCCCGAAGTGACCTGCGTGGTGGACGTGTCCCACGAGGACCCTGAAGTGAAGTTCAATTGGTACGTGGACGGCGTG
GAGGTGCACAACGCCAAGACCAAGCCCCGGGAGGAACAGCAGTACAACAGCACCTACCGGGTGGTGTCCGTGCTGACCGTGCTGCACCAG
GACTGGCTGAACGGCAAGGAGTACAAGTGCAAGGTCTCCAACAAGGCCCTGCCCGCCCCCATCGAGAAAACCATCAGCAAGGCCAAG
GGCCAGCCCCAGAGAACCCCAGGTGTACACCCTGCCCCCCAGCCGGGAGGAGATGACCAAGAACCAGGTGTCCCTGACCTGCCTGGTG
AAGGGCTTCTACCCCAGCGATATCGCCGTGGAGTGGGAGAGCAATGGGCAGCCTGAGAACAACTACAAGACCACCCCCTGTCCTG
GACAGCGACGGCAGCTTCTTCCTGTACTCCAAACTGACCGTGGACAAGAGCAGGTGGCAGCAGGGGAACGTGTTCAGCTGCAGCGTG
ATGCACGAGGCCCTGCACAACCACTACACCCAGAAGTCCCTGGCCCTGTCTCCGGGCAAGGGGGAAGTGGAGGCGGAGGA
AGCGGGAGGCGGAGGGCGGAAGCGGAGGCGGAGGATCTGGCGGCGACTGAGCAGCTGCTTCGGCCTGAAGCTGGACCGGATCGGCAGC
ATGAGCGGCCCTGGGCTGCTGA (SEQ ID NO: 803)

FIG. 16C

NC2B-28 DNA Sequence

ATGGGCGTGCACGAGTGTCCTGCCTGCTGTGGCTGCTGCTGAGCCTGCTGTCTCTGTGGCCTGGCCTACGCCGACAAGACCCAC
ACCTGTCCCCCCTGTCCTGCCCCTGGGACGCTGCTGAGCTGCCCAGCGTGTTCCTGTTCCCCCAAAGCCCAAGGACACCTGATGATC
AGCCGGACCCCCGAAGTGACCTGCGTGGTGGTGGACGTGTCCCACGAGGACCCTGAAGTGAAGTTCAATTGGTACGTGGACGGCGTG
GAGGTGCACAATGCCAAGACGCCAAGACCACAGAACAGCACCTACCGGGTGGTGTCCGTGCTGACCGTGCTGCACCAG
GACTGGCTGAACGGCAAAGAGTACAAGTGCAAAGTCTCCAACAAAGCCCTGCCCGCCCCCATCGAGAAAACCATCAGCAAGGCCAAG
GGCCAGCCCCAGAGAACCCCAGTGTACACCCTGCCCCCCAGCCGGGAGGAGAATGACCAGGTGTCCCTGACCTGCCTGGTG
AAGGGCTTCTACCCCAGCGATATCGCCGTGGAGTGGGAGAGCAACGGCCAGCCTGAGAACAACTACAAGACCACCCCCCTGTGCTG
GACAGCGACGGCAGCTTCTTCCTGTACTCCAAACTGACCGTGGACAAGAGCCGGTGGCAGCAGGGCAACGTGTTCAGCTGCAGCGTG
ATGCACGAGGCCCTGCACAACCACTACACCCAGAAGTCCCTGAGCCTGTCTCCGGGCAAGGGCGAGGAGTGGGAAGTGGAGCGGAGGA
AGCGGGGGGAGGCGGAAGCGGAGGCGGAGGATCTGGCGGGCGGAGGCGGACTGAGCAAGGGCGGACTGAGCAAGGGCGACGAGCAAGGGCTGCTTCGGCCTGAAG
CTGGACCCGGATCGGCAGCATGAGCGGCCTGCTGA (SEQ ID NO: 804)

FIG. 16D

NC2B-34 DNA Sequence

ATGGGCCGTGCACGAGTGTCCTGCCTGGCCTGTGCTGCTGAGCCTGCTGTCTCTGTGGCCTGGCGCCTACGCCGACAAGACCCAC
ACCTGTCCCCCCTGTCCTGCCCCTGAGCTGCTGGGCGGACCCAGCGTGTTCCTGTTCCCCCCAAAGCCCAAGGACACCCTGATGATC
AGCCGGACCCCCGAAGTGACCTGCGTGGTGGTGGACGTGTCCCACGAGGACCCTGAAGTGAAGTTCAATTGGTACGTGGACGGCGTG
GAGGTGCACAACGCCAAGACCAAGCCCCGGGAGGAACAGTACAACAGCACCTACCGGGTGGTGTCCGTGCTGACCGTGCTGCACCAG
GACTGGCTGAACGGCAAAGAGTACAAGTGCAAGGTCTCCAACAAGGCCCTGCCTGCCCCCATCGAGAAAACCATCAGCAAGGCCAAG
GGCCAGCCCAGAGAACCCCAGGTGTACACCCTGCCCCCCAGCCGGGAGGAAATGACCAAGAACCAGGTGTCCCTGACCTGCCTGGTG
AAGGGCTTCTACCCCAGCGATATCGCCGTGGAGTGGGAGAGCAACGGCCAGCCTGAGAACAACTACAAGACCACCCCCCTGTGCTG
GACAGCGACGGCAGCTTCTTCCTGTACTCCAAACTGACCGTGGACAAGAGCCGGTGGCAGCAGGGCAACGTGTTCAGCTGCAGCGTG
ATGCACGAGGCCCTGCACAACCACTACACCCAGAAGTCCCTGAGCCTGTCTCCGGCAAGGGCGGAGGGCGAGGTGGAGGCGGAGGA
AGCGGGGAGGCGGAGGCGGAAGCGGGAGGATCGGAGGCGGAGAGCCTGGAGAGCCCTGAGGCGGAGGCGGAGGGACTGAGCAAG
GGCTGCTTCGGCCTTGAAGCTGGACCGGATCGGCAGCATGAGCGGCCTGGCTGCTGA (SEQ ID NO: 805)

NPR-B Dose-Response Whole Cell Assay Comparing NC2-22, NC2-28, NC2-34 to NC2st

FIG. 18

NC2 Variants

NC2-KGANKK (w/sig. seq.)

MGVHECPAWLWLLLSLLSLWPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGK*GGGGSGGGGS*KGANKK*GISKCFGIKLDRTCGMSGTCC*
(SEQ ID NO: 511)

NC2-KGANKK (w/o sig. seq.)

DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDK
SLSLSPGK*GGGGSGGGGS*KGANKK*GISKCFGIKLDRTCGMSGTCC* (SEQ ID NO: 512)

NC2-KGANQK (w/sig. seq.)

MGVHECPAWLWLLLSLLSLWPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGK*GGGGSGGGGS*KGANQK*GISKCFGIKLDRTCGMSGTCC*
(SEQ ID NO: 513)

NC2-KGANQK (w/o sig. seq.)

DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDK
SLSLSPGK*GGGGSGGGGS*KGANQK*GISKCFGIKLDRTCGMSGTCC* (SEQ ID NO: 514)

FIG. 19

NC2 Variants

NC2-CNP53mut2 (w/sig. seq.)

MGVHECPAWLWLLLSLLSLWPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGK*GGGDLQVDTQSQAAWAQLLQEHPNAQQYKGANKK*GLSKGG
FGLKLDRLGSMSGLGC (SEQ ID NO: 515)

NC2-CNP53mut2 (w/o sig. seq.)

DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
SLSLSPGK*GGGDLQVDTQSQAAWAQLLQEHPNAQQYKGANKKGLSKGCFGLKLDRLGSMSGLGC* (SEQ ID
NO: 516)

FIG. 20

Fc-CNP53 Constructs

Fc-CNP53-A
(w/sig. seq.)

MGVHECPAWLMLLSLLSLWPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGK*GGGDLRVDTKSRAAWARLLQEHPNARKYKGANKKGLSKG*
*FGKKLDRIGSASGLGC* (SEQ ID NO: 517)

Fc-CNP53-A
(w/o sig. seq.)

DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
SLSLSPGK*GGGDLRVDTKSRAAWARLLQEHPNARKYKGANKKGLSKGFGKKLDRIGSASGLGC* (SEQ ID
NO: 518)

Fc-CNP53-AAA
(w/sig. seq.)

MGVHECPAWLMLLSLLSLWPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGK*GGGDLRVDTKSRAAWARLLQEHPNARKYKGANAAGLSKG*
*FGKKLDRIGSASGLGC* (SEQ ID NO: 519)

Fc-CNP53-AAA
(w/o sig. seq.)

DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
SLSLSPGK*GGGDLRVDTKSRAAWARLLQEHPNARKYKGANAAGLSKGFGKKLDRIGSASGLGC* (SEQ ID
NO: 520)

Dose-Response Curves for CNP, Fc-CNP53-A (Fc-CNP53wt), and Fc-CNP53-AAA (Fc-CNP53mut) (NPR-B Membranes)

Dose-Response Curves for CNP, NC2st, Fc-CNP53-A (Fc-CNP53wt), and Fc-CNP53-AAA (Fc-CNP53mut) (NPR-B Membranes)

Dose-Response Curves for CNP, NC2st, Fc-CNP53-A (Fc-CNP53wt), and Fc-CNP53-AAA (Fc-CNP53mut) (NPR-B Whole Cells)

FIG. 22

NP Multiple Sequence Alignment and CDNP Constructs

```
Human ANP                         SLRRSSCFGGRMDRIGAQSGLGCNSFRY                  (SEQ ID NO: 1)
Rat ANP                           SLRRSSCFGGRIDRIGAQSGLGCNSFRY                  (SEQ ID NO: 96)
Urodilatin                  TAPRSLRRSSCFGGRMDRIGAQSGLGCNSFRY                    (SEQ ID NO: 2)
Human BNP                        SPKMVQGSGCFGRKMDRISSSSGLGCKVLRRH               (SEQ ID NO: 3)
Rat BNP        SQDSAFRIQERLRNSKMAHSSSCFGQKIDRIGAVSRLGCDGLRLF                    (SEQ ID NO: 97)
Pig BNP                       SPKTMRDSGCFGRRLDRIGSLSGLGCNVLRRY                  (SEQ ID NO: 98)
DNP                             EVKYDPCFGHKIDRINHVSNLGCPSLRDPRPNAPSTSA          (SEQ ID NO: 5)
TNP-C                         SDSKIGNGCFGFPLDRIGSVSGLGCNRIMQNPPKKFSGE           (SEQ ID NO: 99)
CDNP                            GLSKGCFGLKLDRIGSMSGLGCPSLRDPRPNAPSTSA           (SEQ ID NO: 100)
                                    ***  : *** *** *****  :  :

CDNP-N1                         GLSKGCFGLKLDRIGSMSGLGCNSLRDPRPNAPSTSA           (SEQ ID NO: 101)
CDNP-G1 (C8)                    GLSKGCFGLKLDRIGSMSGLGCGSLRDPRPNAPSTSA           (SEQ ID NO: 102)
CDNP-H1 (C9)                    GLSKGCFGLKLDRIGSMSGLGCHSLRDPRPNAPSTSA           (SEQ ID NO: 103)
CDNP-K1                         GLSKGCFGLKLDRIGSMSGLGCKSLRDPRPNAPSTSA           (SEQ ID NO: 104)
CDNP-Z1 (Z=hydroxyproline)      GLSKGCFGLKLDRIGSMSGLGCZSLRDPRPNAPSTSA           (SEQ ID NO: 105)
CDNP-S3                         GLSKGCFGLKLDRIGSMSGLGCPSSRDPRPNAPSTSA           (SEQ ID NO: 106)
CDNP-A4                         GLSKGCFGLKLDRIGSMSGLGCPSLADPRPNAPSTSA           (SEQ ID NO: 107)
CDNP-A5                         GLSKGCFGLKLDRIGSMSGLGCPSLRAPRPNAPSTSA           (SEQ ID NO: 108)
CDNP-S3A4 (C12)                 GLSKGCFGLKLDRIGSMSGLGCPSSADPRPNAPSTSA           (SEQ ID NO: 109)
CDNP-A4A5                       GLSKGCFGLKLDRIGSMSGLGCPSLAAPRPNAPSTSA           (SEQ ID NO: 110)
CDNP-S3A5 (C11)                 GLSKGCFGLKLDRIGSMSGLGCPSSRAPRPNAPSTSA           (SEQ ID NO: 111)
CDNP-(A17)S3A5                  GLSKGCFGLKLDRIGSASGLGCPSSRAPRPNAPSTSA           (SEQ ID NO: 112)
CDNP-S3A4A5 (C10)               GLSKGCFGLKLDRIGSMSGLGCPSSAAPRPNAPSTSA           (SEQ ID NO: 113)
CDNP-(A17)S3A4A5                GLSKGCFGLKLDRIGSASGLGCPSSAAPRPNAPSTSA           (SEQ ID NO: 114)
CDNP-S3A4A5R6 (C13)             GLSKGCFGLKLDRIGSMSGLGCPSSAARRPNAPSTSA           (SEQ ID NO: 115)
CDNP-S3A4A5S7 (C14)             GLSKGCFGLKLDRIGSMSGLGCPSSAAPSPNAPSTSA           (SEQ ID NO: 116)

DNP TAIL                                             PSLRDPRPNAPSTSA            (SEQ ID NO: 117)
CONSENSUS SEQUENCE FOR DNP C-TERMINAL TAIL           XSXXXXPNAPSTSA             (SEQ ID NO: 118)
```

Dose-Response Curves for CDNP Variants (NPR-B Membranes)

Dose-Response Curves for CDNP Variants (NPR-B Membranes)

Dose-Response Curves for CDNP Variants (NPR-A Membranes)

Dose-Response Curves for CDNP Variants (NPR-A Membranes)

FIG. 26A

Exemplary Constructs Having N-terminal NP fused to C-terminal Fc Domain

CNP-16AAlinker-Fc-His10 (NC1)
CLSKCCIELFRIGSMSGLCCGGGSGGGGSGGGGSGDKTHTCPPCPAPELLGGPSVFLFPPKPKDTLMISR
TPEVTCVVVDVSHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSD
GSFFLYSKLTVDKSRWQQGNVFSCSVMHEALHNHYTQKSLSLSPGKGGENLYFQGSHHHHHHHHHH (SEQ
ID NO: 521)

CNP-6AAlinker-Fc-His10 (NC3)
CLSKCCIELFRIGSMSGLCCGGGGSGDKTHTCPPCPAPELLGGPSVFLFPPKPKDTLMISRTPEVTCVVVD
VSHEDPEVKFNWYVDGVEVHNAKTKPREEQYNSTYRVVSVLTVLHQDWLNGKEYKCKVSNKALPAPIEKTISK
AKGQPREPQVYTLPPSREEMTKNQVSLTCLVKGFYPSDIAVEWESNGQPENNYKTTPPVLDSDGSFFLYSKLT
VDKSRWQQGNVFSCSVMHEALHNHYTQKSLSLSPGKGGENLYFQGSHHHHHHHHHH(SEQ ID NO: 522)

CNP-6AAlinker-Fc
CLSKCCIELFRIGSMSGLCCGGGGSGDKTHTCPPCPAPELLGGPSVFLFPPKPKDTLMISRTPEVTCVVVD
VSHEDPEVKFNWYVDGVEVHNAKTKPREEQYNSTYRVVSVLTVLHQDWLNGKEYKCKVSNKALPAPIEKTISK
AKGQPREPQVYTLPPSREEMTKNQVSLTCLVKGFYPSDIAVEWESNGQPENNYKTTPPVLDSDGSFFLYSKLT
VDKSRWQQGNVFSCSVMHEALHNHYTQKSLSLSPGK(SEQ ID NO: 523)

CDNP-Fc
SNSCFGLKLDRIGSMSSLGCPSILRDPNAPSSSADKTHTCPPCPAPELLGGPSVFLFPPKPKDTLMISRT
PEVTCVVVDVSHEDPEVKFNWYVDGVEVHNAKTKPREEQYNSTYRVVSVLTVLHQDWLNGKEYKCKVSNKALP
APIEKTISKAKGQPREPQVYTLPPSREEMTKNQVSLTCLVKGFYPSDIAVEWESNGQPENNYKTTPPVLDSDG
SFFLYSKLTVDKSRWQQGNVFSCSVMHEALHNHYTQKSLSLSPGK(SEQ ID NO: 524)

CDNP-A17saa-Fc
CLSKCCIELFRIGSASGLGCPSSAAPRNASTSADKTHTCPPCPAPELLGGPSVFLFPPKPKDTLMISRT
PEVTCVVVDVSHEDPEVKFNWYVDGVEVHNAKTKPREEQYNSTYRVVSVLTVLHQDWLNGKEYKCKVSNKALP
APIEKTISKAKGQPREPQVYTLPPSREEMTKNQVSLTCLVKGFYPSDIAVEWESNGQPENNYKTTPPVLDSDG
SFFLYSKLTVDKSRWQQGNVFSCSVMHEALHNHYTQKSLSLSPGK(SEQ ID NO: 525)

CDNP-A17sra-Fc
CLSKCCIELFRIGSASGLGCPSSRAPRNAPSTSADKTHTCPPCPAPELLGGPSVFLFPPKPKDTLMISRT
PEVTCVVVDVSHEDPEVKFNWYVDGVEVHNAKTKPREEQYNSTYRVVSVLTVLHQDWLNGKEYKCKVSNKALP
APIEKTISKAKGQPREPQVYTLPPSREEMTKNQVSLTCLVKGFYPSDIAVEWESNGQPENNYKTTPPVLDSDG
SFFLYSKLTVDKSRWQQGNVFSCSVMHEALHNHYTQKSLSLSPGK (SEQ ID NO: 526)

FIG. 26B

NC1 DNA Sequence

ATGGGGCGTGCACGAGTGTCCTGCCTGGCTGCTGTGGCTGTCTGTGCCTGCTGTCTCTGTGCCTGCGCCTGGCCTGAGCAAG
GGCTGCTTCGGCCTGAAGCTGGACCGGATCGGCAGCATGTCTGGCCTGGAGGCGGAGGATCTGGCGGCCGGAGGAAGTGGC
GGAGGCGGCAGCGGCGATAAGACCCACACCTGTCCCCCTTGTCCTGCCCCTGAGCTGCTGGGGGACCTGCTGTTCCTGTTCCCC
CCAAAGCCCAAGGACACACCCTGATGATCAGCCGGACCCCCGAAGTGACCTGCGTGGTGGACGTGTCCCACGAGGACCCTGAAGTG
AAGTTCAATTGGTACGTGGACGGCGTGGAGGTGCACAACGCCAAGACCAAGCCCCGGGAGGAACAGTACAACAGCACCTACCGGGTG
GTGTCCGTGCTGACCGTGCTGCACCAGGACTGGCTGAACGGCAAAGAGTACAAGTGCAAGGTCTCCAACAAGGCCCTGCCTGCCCCC
ATCGAGAAAACCATCAGCAAGGCCAAGGGCCAGCCCAGGGTGTACACCCTGCCCCCAGCCGGGAGGAGAAATGACCAAG
AACCAGGTGTCCCTGACCTGCCTGGTGAAGGGCTTCTACCCCAGCGATATCGCCGTGGAGTGGGAGAGCAACGGCCAGCCTGAGAAC
AACTACAAGACCACCCCCCCTGTGCTGGACAGCGACGGCAGCTTCTTCCTGTACTCCAAACTGACCGTGGACAAGAGCCGGTGGCAG
CAGGGCAACGTGTTCAGCTGCAGCGTGATGCACGAGGCCCTGCACAACCACTACACCCAGAAGTCCCTGAGCCTGTCTCCTGGCAAG
GGCGGCGAGAACCTGTACTTTCAGGGCAGCCACCACCATCACCATCACCATCATCACTGA (SEQ ID NO: 806)

Dose-Response Curves for CNP, CDNP, CDNP-Fc (NPR-B Membranes)

Dose-Response Curves for CNP, CDNP-Fc (NPR-B Membranes)

Dose-Response Curves: HEK-NPR-B Whole Cell cGMP Assays

Dose-Response Curves: HEK-NPR-A Whole Cell cGMP Assays

|  | EC$_{50}$ (nM) | EC$_{50}$ ratio | % Efficacy | % AUC |
|---|---|---|---|---|
| ANP | 0.31 | --- | --- | --- |
| SAA | ND | ND | 0.25 | 2.5 |
| SRA | ND | ND | 0.32 | 1.2 |

■ ANP
● CDNPsaaFc
○ CDNPsraFc

FIG. 29

Human CNP22 and Point Mutations at Position 17

```
CNP22           GLSKGCFGLKLDRIGSMSGLGC  (SEQ ID NO: 4)
CNP-F17  (C15)  GLSKGCFGLKLDRIGSFSGLGC  (SEQ ID NO: 119)
CNP-L17  (C16)  GLSKGCFGLKLDRIGSLSGLGC  (SEQ ID NO: 120)
CNP-I17  (C17)  GLSKGCFGLKLDRIGSISGLGC  (SEQ ID NO: 121)
CNP-T17  (C18)  GLSKGCFGLKLDRIGSTSGLGC  (SEQ ID NO: 122)
CNP-V17  (C19)  GLSKGCFGLKLDRIGSVSGLGC  (SEQ ID NO: 123)
CNP-A17  (C1)   GLSKGCFGLKLDRIGSASGLGC  (SEQ ID NO: 124)
CNP-S17         GLSKGCFGLKLDRIGSSSGLGC  (SEQ ID NO: 125)
CNP-E17         GLSKGCFGLKLDRIGSESGLGC  (SEQ ID NO: 156)
CNP-R17         GLSKGCFGLKLDRIGSRSGLGC  (SEQ ID NO: 157)
CNP-Y17         GLSKGCFGLKLDRIGSYSGLGC  (SEQ ID NO: 158)

CONSENSUS:      GLSKGCFGLKLDRIGSXSGLGC  (SEQ ID NO: 126)
```

Dose-Response Curves for CNP Variants (NPR-B)

FIG. 31

CNP Variants

| Name | Sequence | SEQ ID NO |
|---|---|---|
| CNP22 | GLSKGCFGLKLDRIGSMSGLGC | (SEQ ID NO: 4) |
| CNP37 | QEHPNARKYKGANKKGLSKGCFGLKLDRIGSMSGLGC | (SEQ ID NO: 127) |
| E6PGCNP37 | EEEEEEPGQEHPNARKYKGANKKGLSKGCFGLKLDRIGSMSGLGC | (SEQ ID NO: 128) |
| C1(E6) | EEEEEESGGGSGGGGSGGGGLSKGCFGLKLDRIGSMSGLGC | (SEQ ID NO: 129) |
| C2(E6) | EEEEEEASTSPANPQPAASSPGLSKGCFGLKLDRIGSMSGLGC | (SEQ ID NO: 130) |
| C3(E6) | EEEEEEPSSAAPQPNAPSTSAGLSKGCFGLKLDRIGSMSGLGC | (SEQ ID NO: 131) |
| C4(E6) | EEEEEESGGGGSGGGGKGANKKGLSKGCFGLKLDRIGSMSGLGC | (SEQ ID NO: 132) |
| C5(E6) | EEEEEESGGGGSGGGGKGANQQGLSKGCFGLKLDRIGSMSGLGC | (SEQ ID NO: 133) |
| C6(E6) | EEEEEESGGGGSGGGGKGANKQGLSKGCFGLKLDRIGSMSGLGC | (SEQ ID NO: 134) |
| C7(E6) | EEEEEESGGGGSGGGQGANKKGLSKGCFGLKLDRIGSMSGLGC | (SEQ ID NO: 135) |
| C8(E6) | EEEEEESGGGGSGGGKGANQKGLSKGCFGLKLDRIGSMSGLGC | (SEQ ID NO: 136) |
| C9(E6) | EEEEEESGGGGSGGGKGANQQGLSKGCFGLKLDRIGSMSGLGC | (SEQ ID NO: 137) |
| C10(E6) | EEEEEESGGGGSGGGQGANQKGLSKGCFGLKLDRIGSMSGLGC | (SEQ ID NO: 138) |
| C11(E6) | EEEEEESGGGGSGGGQGANQQGLSKGCFGLKLDRIGSMSGLGC | (SEQ ID NO: 139) |
| D6CNP37 | EEEEEESGGGGSQEHPNARKYKGANKKGLSKGCFGLKLDRIGSMSGLGC | (SEQ ID NO: 140) |
| C1(D6) | DDDDDDSGGGSGGGGSGGGGLSKGCFGLKLDRIGSMSGLGC | (SEQ ID NO: 141) |
| C2(D6) | DDDDDDASTSPANPQPAASSGGLSKGCFGLKLDRIGSMSGLGC | (SEQ ID NO: 142) |
| C3(D6) | DDDDDDGSSAAPQPNAPSTSAGLSKGCFGLKLDRIGSMSGLGC | (SEQ ID NO: 143) |
| C4(D6) | DDDDDDSGGGGSGGGKGANKKGLSKGCFGLKLDRIGSMSGLGC | (SEQ ID NO: 144) |
| C5(D6) | DDDDDDSGGGGSGGGKGANQQGLSKGCFGLKLDRIGSMSGLGC | (SEQ ID NO: 145) |
| C6(D6) | DDDDDDSGGGGSGGGKGANQKGLSKGCFGLKLDRIGSMSGLGC | (SEQ ID NO: 146) |
| D6-14AAlinker-CNP | DDDDDDGGGGSGGGGSGGGGSGLSKGCFGLKLDRIGSMSGLGC | (SEQ ID NO: 147) |
| CNP-14AAlinker-D6 | GLSKGCFGLKLDRIGSMSGLGC*GGGGSGGGGSGGGGS*DDDDDD (SEQ ID NO: 148) |  |
| CNP-Nterm1 | *GSSAAPRPNAPSTSAGLSKGCFGLKLDRIGSMSGLGC* | (SEQ ID NO: 149) |
| CNP-Nterm2 | *ASTSPANPRPAASSGGLSKGCFGLKLDRIGSMSGLGC* | (SEQ ID NO: 150) |

FIG. 32A

Additional CNP Variants

| Sequence | SEQ ID NO |
|---|---|
| GDLRVDTKSRAAWARLLQEHPNARKYKGANKKGLSKGCFGLKLDRIGSMSGLGC | SEQ ID NO:1001 |
| PDLRVDTKSRAAWARLLQEHPNARKYKGANKKGLSKGCFGLKLDRIGSMSGLGC | SEQ ID NO:1002 |
| MDLRVDTKSRAAWARLLQEHPNARKYKGANKKGLSKGCFGLKLDRIGSMSGLGC | SEQ ID NO:1003 |
| DLRVDTKSRAAWARLLQEHPNARKYKGANKKGLSKGCFGLKLDRIGSNSGLGC | SEQ ID NO:1004 |
| LRVDTKSRAAWARLLQEHPNARKYKGANKKGLSKGCFGLKLDRIGSMSGLGC | SEQ ID NO:1005 |
| RVDTKSRAAWARLLQEHPNARKYKGANKKGLSKGCFGLKLDRIGSMSGLGC | SEQ ID NO:1006 |
| VDTKSRAAWARLLQEHPNARKYKGANKKGLSKGCFGLKLDRIGSMSGLGC | SEQ ID NO:1007 |
| DTKSRAAWARLLQEHPNARKYKGANKKGLSKGCFGLKLDRIGSMSGLGC | SEQ ID NO:1008 |
| TKSRAAWARLLQEHPNARKYKGANKKGLSKGCFGLKLDRIGSMSGLGC | SEQ ID NO:1009 |
| KSRAAWARLLQEHPNARKYKGANKKGLSKGCFGLKLDRIGSMSGLGC | SEQ ID NO:1010 |
| SRAAWARLLQEHPNARKYKGANKKGLSKGCFGLKLDRIGSMSGLGC | SEQ ID NO:1011 |
| RAAWARLLQEHPNARKYKGANKKGLSKGCFGLKLDRIGSMSGLGC | SEQ ID NO:1012 |
| AAWARLLQEHPNARKYKGANKKGLSKGCFGLKLDRIGSMSGLGC | SEQ ID NO:1013 |
| AWARLLQEHPNARKYKGANKKGLSKGCFGLKLDRIGSMSGLGC | SEQ ID NO:1014 |
| WARLLQEHPNARKYKGANKKGLSKGCFGLKLDRIGSMSGLGC | SEQ ID NO:1015 |
| ARLLQEHPNARKYKGANKKGLSKGCFGLKLDRIGSMSGLGC | SEQ ID NO:1016 |
| RLLQEHPNARKYKGANKKGLSKGCFGLKLDRIGSMSGLGC | SEQ ID NO:1017 |
| LLQEHPNARKYKGANKKGLSKGCFGLKLDRIGSMSGLGC | SEQ ID NO:1018 |
| LQEHPNARKYKGANKKGLSKGCFGLKLDRIGSMSGLGC | SEQ ID NO:1019 |
| QEHPNARKYKGANKKGLSKGCFGLKLDRIGSMSGLGC | SEQ ID NO:1020 |
| EHPNARKYKGANKKGLSKGCFGLKLDRIGSMSGLGC | SEQ ID NO:1021 |
| HPNARKYKGANKKGLSKGCFGLKLDRIGSMSGLGC | SEQ ID NO:1022 |
| PNARKYKGANKKGLSKGCFGLKLDRIGSMSGLGC | SEQ ID NO:1023 |
| NARKYKGANKKGLSKGCFGLKLDRIGSMSGLGC | SEQ ID NO:1024 |
| ARKYKGANKKGLSKGCFGLKLDRIGSMSGLGC | SEQ ID NO:1025 |
| RKYKGANKKGLSKGCFGLKLDRIGSMSGLGC | SEQ ID NO:1026 |
| KYKGANKKGLSKGCFGLKLDRIGSMSGLGC | SEQ ID NO:1027 |
| YKGANKKGLSKGCFGLKLDRIGSMSGLGC | SEQ ID NO:1028 |
| KGANKKGLSKGCFGLKLDRIGSMSGLGC | SEQ ID NO:1029 |
| GANKKGLSKGCFGLKLDRIGSMSGLGC | SEQ ID NO:1030 |
| ANKKGLSKGCFGLKLDRIGSMSGLGC | SEQ ID NO:1031 |
| NKKGLSKGCFGLKLDRIGSMSGLGC | |

FIG. 32B

```
                                       KKGLSKGCFGLKLDRIGSMSGLGC  (SEQ ID NO:1032)
                                        KGLSKGCFGLKLDRIGSMSGLGC  (SEQ ID NO:1033)
                                         LSKGCFGLKLDRIGSMSGLGC   (SEQ ID NO:1034)
                                          SKGCFGLKLDRIGSMSGLGC   (SEQ ID NO:1035)
                                           KGCFGLKLDRIGSMSGLGC   (SEQ ID NO:1036)
                                            GCFGLKLDRIGSNSGLGC   (SEQ ID NO:1037)
                   QEHPNARKYKGANKKGLSKGCFGLKLDRIGSMSGLGC         (SEQ ID NO:1038)
                   PQEHPNARKYKGANKKGLSKGCFGLKLDRIGSMSGLGC        (SEQ ID NO:1039)
                   MQEHPNARKYKGANKKGLSKGCFGLKLDRIGSMSGLGC        (SEQ ID NO:1040)
                   GQEHPNARKYKGANKKGLSKGCFGLKLDRIGSMSGLGC        (SEQ ID NO:1041)
                   GQEHPNARKYKGANPKGLSKGCFGLKLDRIGSMSGLGC        (SEQ ID NO:1042)
                   GQEHPNARKYKGANQKGLSKGCFGLKLDRIGSMSGLGC        (SEQ ID NO:1043)
                   GQEHPNARKYKGANQQGLSKGCFGLKLDRIGSMSGLGC        (SEQ ID NO:1044)
                   GQEHPNARKYKGANKPGLSKGCFGLKLDRIGSMSGLGC        (SEQ ID NO:1045)
                   GQEHPNARKYKGANKKGLSKGCFGLKLDRIGSNSGLGC        (SEQ ID NO:1046)
                   PGQEHPNARKYKGANKKGLSKGCFGLKLDRIGSMSGLGC       (SEQ ID NO:1047)
                   MGQEHPNARKYKGANKKGLSKGCFGLKLDRIGSMSGLGC       (SEQ ID NO:1048)
                                      GANRRGLSRGCFGLKLDRIGSMSGLGC (SEQ ID NO:1049)
                                     GANRRGLSRGCFGLKLDRIGSMSGLGC  (SEQ ID NO:1050)
                                    PGANRRGLSRGCFGLKLDRIGSMSGLGC  (SEQ ID NO:1051)
                                    MGANRRGLSRGCFGLKLDRIGSMSGLGC  (SEQ ID NO:1052)
                   GHKSEVAHRFKGANKKGLSKGCFGLKLDRIGSMSGLGC         (SEQ ID NO:1053)
                   GHKSEVAHRFKGANKKGLSKGCFGLKLDRIGSNSGLGC         (SEQ ID NO:1054)
                   PGHKSEVAHRFKGANKKGLSKGCFGLKLDRIGSMSGLGC        (SEQ ID NO:1055)
                   MGHKSEVAHRFKGANKKGLSKGCFGLKLDRIGSMSGLGC        (SEQ ID NO:1056)
                                       RGLSRGCFGLKLDRIGSMSGLGC   (SEQ ID NO:1057)
                                      ERGLSRGCFGLKLDRIGSMSGLGC   (SEQ ID NO:1058)
                                     GANQQGLSKGCFGLKLDRIGSMSGLGC (SEQ ID NO:1059)
                                     GANRRGLSKGCFGLKLDRIGSMSGLGC (SEQ ID NO:1060)
                                     GANPRGLSKGCFGLKLDRIGSMSGLGC (SEQ ID NO:1061)
                                     GANSSGLSKGCFGLKLDRIGSMSGLGC (SEQ ID NO:1062)
```

FIG. 32C

| | |
|---|---|
| GANPRGLSRGCFGLKLDRIGSMSGLGC | (SEQ ID NO:1063) |
| GANRRGLSRGCFGLKLDRIGSMSGLGC | (SEQ ID NO:1064) |
| GANQQGLSRGCFGLKLDRIGSMSGLGC | (SEQ ID NO:1065) |
| GANSSGLSRGCFGLKLDRIGSMSGLGC | (SEQ ID NO:1066) |
| AAWARLLQEHPNAGLSKGCFGLKLDRIGSMSGLGC | (SEQ ID NO:1067) |
| AAWARLLQEHPNARGLSKGCFGLKLDRIGSMSGLGC | (SEQ ID NO:1068) |
| DLRVDTKSRAAWARGLSKGCFGLKLDRIGSMSGLGC | (SEQ ID NO:1069) |
| GQEHPNARKYKGANPKGLSKGCFGLKLDRIGSMSGLGC | (SEQ ID NO:1070) |
| GQEHPNARKYKGANQKGLSKGCFGLKLDRIGSMSGLGC | (SEQ ID NO:1071) |
| GLSRGCFGLKLDRIGSMSGLGC | (SEQ ID NO:1072) |
| ERGLSKGCFGLRLDRIGSMSGLGC | (SEQ ID NO:1073) |
| RGLSKGCFGLKLDRIGSMSGLGC | (SEQ ID NO:1074) |
| GLSKGCFGLKLDRIGSMSGLGC | (SEQ ID NO:1075) |
| GLSKGCXGLKLDRIGSMSGLGC | (SEQ ID NO:1076) |
| GLSKGCXGLKLDRIGSMSGLGC | (SEQ ID NO:1077) |
| RLSKGCFGLKLDRIGSMSGLGC | (SEQ ID NO:1078) |
| ELSKGCFGLKLDRIGSMSGLGC | (SEQ ID NO:1079) |
| GLSKRCFGLKLDRIGSMSGLGC | (SEQ ID NO:1080) |
| GLSKQCFGLKLDRIGSMSGLGC | (SEQ ID NO:1081) |
| GLSKSCFGLKLDRIGSMSGLGC | (SEQ ID NO:1082) |
| GLSKGCFGLKLDRISSMSGLGC | (SEQ ID NO:1083) |
| GLSKGCFGLKLDRINSMSGLGC | (SEQ ID NO:1084) |
| GLSKGCFGLKLDRIRSMSGLGC | (SEQ ID NO:1085) |
| GLSKGCFGLKLDRIXSMSGLGC | (SEQ ID NO:1086) |
| GLSKGCFGLKLDRIGSMSSLGC | (SEQ ID NO:1087) |
| GLSKGCFGLKLDRIGSMSRLGC | (SEQ ID NO:1088) |
| GLSKGCFGLKLDRIGSMSNLGC | (SEQ ID NO:1089) |
| GLSKGCFGLKLDRIGSMSGLSC | (SEQ ID NO:1090) |
| GLSKGCFGLKLDRIGSMSGLTC | (SEQ ID NO:1091) |
| GLSKGCFGLKLDRIGSMSGLRC | (SEQ ID NO:1092) |
| GLSKGCXFGLKLDRIGSMSGLGC | (SEQ ID NO:1093) |

(X: D-Phe)
(X: 3-amino-2-phenylpropionic acid)

(X: Cit)

(X: [CH₂NH]bond)

FIG. 32D

```
                              GLSKGCXGLKLDRIGSMSGLGC          (SEQ ID NO:1094)
                              GLSKGCFXLKLDRIGSMSGLGC          (SEQ ID NO:1095)
                              GLSKGCXGLKLDRIGSMSGLGC          (SEQ ID NO:1096)
        GQPREPQVYTLPPSGLSKGCFGLKLDRIGSMSGLGC                  (SEQ ID NO:1097)
        GERAFKAWAVARLSQGLSKGCFGLKLDRIGSMSGLGC                 (SEQ ID NO:1098)
        GQHKDDNPNLPRGANPRGLSKGCFGLKLDRIGSMSGLGC               (SEQ ID NO:1099)
        GHHSHEQHPHGANQQGLSKGCFGLKLDRIGSMSGLGC                 (SEQ ID NO:1100)
        GAHHPHEHDTHGANQQGLSKGCFGLKLDRIGSMSGLGC                (SEQ ID NO:1101)
           FGIPMDRIGRNPRGLSKGCFGLKLDRIGSMSGLGC                (SEQ ID NO:1102)
        GKRTGQYKLGSKTGPGPKGLSKGCFGLKLDRIGSMSGLGC              (SEQ ID NO:1103)
                SFKMVQGSGCFGLKLDRIGSMSGLGCKVLRRH              (SEQ ID NO:1104)
        GQPREPQVYTGANQQGLSRGCFGLKLDRIGSMSGLGC                 (SEQ ID NO:1105)
        GVPQVSTSTGANQQGLSRGCFGLKLDRIGSMSGLGC                  (SEQ ID NO:1106)
        GQPSSSSSQSTGANQQGLSRGCFGLKLDRIGSMSGLGC                (SEQ ID NO:1107)
        GSTGQWHSESGANQQGLSRGCFGLKLDRIGSMSGLGC                 (SEQ ID NO:1108)
        GQTHSSGTQSGANQQGLSRGCFGLKLDRIGSMSGLGC                 (SEQ ID NO:1109)
        GSSSSSSSSGANQQGLSRGCFGLKLDRIGSMSGLGC                  (SEQ ID NO:1110)
                              GLSKGCX₁FGX₂KLDRIGSMSGX₃GC      (SEQ ID NO:1111)
                              GLSKGCFGX₁KLDRIGSMSGX₂GC        (SEQ ID NO:1112)
                              GLSKGCFGX₁KX₂DRIGSMSGX₃GC       (SEQ ID NO:1113)
                              GLSKGCFGX₁KX₂DRIGSMSGLGC        (SEQ ID NO:1114)
                              GLSRGCYGLKLDRIGSMSGLGC          (SEQ ID NO:1115)
                              GLSRGCFVLKLDRIGSMSGLGC          (SEQ ID NO:1116)
                              GLSRGCFSLKLDRIGSMSGLGC          (SEQ ID NO:1117)
                              GLSRGCFTLKLDRIGSMSGLGC          (SEQ ID NO:1118)
                              GLSRGCFGLKLDRIGSMSGLGC          (SEQ ID NO:1119)
                              GLSRGCFGLKLDRIRSMSGLGC          (SEQ ID NO:1120)
                              GLSRGCFGLKLDRIXSMSGLGC          (SEQ ID NO:1121)
                              GLSRGCFGLKLDRIGSVSGLGC          (SEQ ID NO:1122)
                              GLSRGCFGLKLDRIGSMSGVGC          (SEQ ID NO:1123)
                              GLSRGCFGLKLDRIGSMSGXGC          (SEQ ID NO:1124)
```

(X: N-Me-Phe)

(X: t-Bu-Gly)

(X: NHCH₂CH(Ph)CO)

(X₁: [CH₂NH] bond; X₂ and X₃: N-Me-Leu)

(X₁ and X₂: N-Me-Leu)

(X₁, X₂, and X₃: N-Me-Leu)

(X₁ and X₂: N-Me-Leu)

(X: Cit)

(X: t-Bu-Ala)

FIG. 32E

```
                         ELSEGCFGLKLDRIGSMSGLGC    (SEQ ID NO:1125)
(X: pentanoic acid)      XELSEGCFGLKLDRIGSMSGLGC   (SEQ ID NO:1126)
(X: heptanoic acid)      XELSEGCFGLKLDRIGSMSGLGC   (SEQ ID NO:1127)
(X: pentanoic acid)      XELSKGCFGLKLDRIGSMSGLGC   (SEQ ID NO:1128)
(X: heptanoic acid)      XELSKGCFGLKLDRIGSMSGLGC   (SEQ ID NO:1129)
                         GLSKGCFGLXLDRIGSMSGLGC    (SEQ ID NO:1130)
(X: Cit)                 GLSKGCFGLQLDRIGSMSGLGC    (SEQ ID NO:1131)
                         GLSKGCFGLRLDRIGSMSGLGC    (SEQ ID NO:1132)
                         GLSKGCFGLKLDRINSMSGLGC    (SEQ ID NO:1133)
                         GLSKGCFGLKLDRISSMSGLGC    (SEQ ID NO:1134)
(all D-amino acids)      GLSKGCFGLKLDRIGSMSGLGC    (SEQ ID NO:1135)
(X: N-Me-Leu)            GLSKGCFGXKLDRIGSMSGLGC    (SEQ ID NO:1136)
(X: N-Me-Leu)            GLSKGCFGLKXDRIGSMSGLGC    (SEQ ID NO:1137)
(X: N-Me-Leu)            GLSKGCFGLKXDRIGSMSGLGC    (SEQ ID NO:1138)
(X: 3,4-dichloro-Phe)    GLSKGCFGLKLDRIGSMSGXGC    (SEQ ID NO:1139)
(X: 3-Me-Phe)            GLSGGCXGLKLDRIGSMSGLGC    (SEQ ID NO:1140)
                         GLSGGCXGLKLDRIGSMSGLGC    (SEQ ID NO:1141)
                         GLSRSCFGLKLDRIGSMSSLGC    (SEQ ID NO:1142)
                         GLSRRCFGLKLDRIGSMSGLGC    (SEQ ID NO:1143)
                         GLSGGCFGLKLDRIGSMSGRGC    (SEQ ID NO:1144)
                         GLSGGCFGLSLDRIGSMSGLGC    (SEQ ID NO:1145)
                         GLSRGCFGLKLDRIGQMSGLGC    (SEQ ID NO:1146)
                         GLSRGCFGLKLDRIGSNSGLGC    (SEQ ID NO:1147)
                         GLSRGCFGLKLDRIGSMSSLGC    (SEQ ID NO:1148)
                         GLSRGCFGLKLDRIGSMSRIGC    (SEQ ID NO:1149)
                         GLSRGCFGLKLDRIGSMSGRGC    (SEQ ID NO:1150)
                         GLSRGCFGLKLDRIGSMSGLSC    (SEQ ID NO:1151)
                         GLSRGCFGLKLDRIGSMSGLTC    (SEQ ID NO:1152)
                         GLSRGCFGLKLDRIGSMSGLRC    (SEQ ID NO:1153)
(X: D-Phe)               GLSKGCXGLKLDRIGSMSGLGC    (SEQ ID NO:1154)
(X: 3-Cl-Phe)            GLSKGCXGLKLDRIGSMSGLGC    (SEQ ID NO:1155)
                         RSSCFGGRISRIGACFFFFF
```

Study in WT (CD-1) Mice: Mean Crown-Rump Length

Study in WT (CD-1) Mice: Crown-Rump Length at Day 36

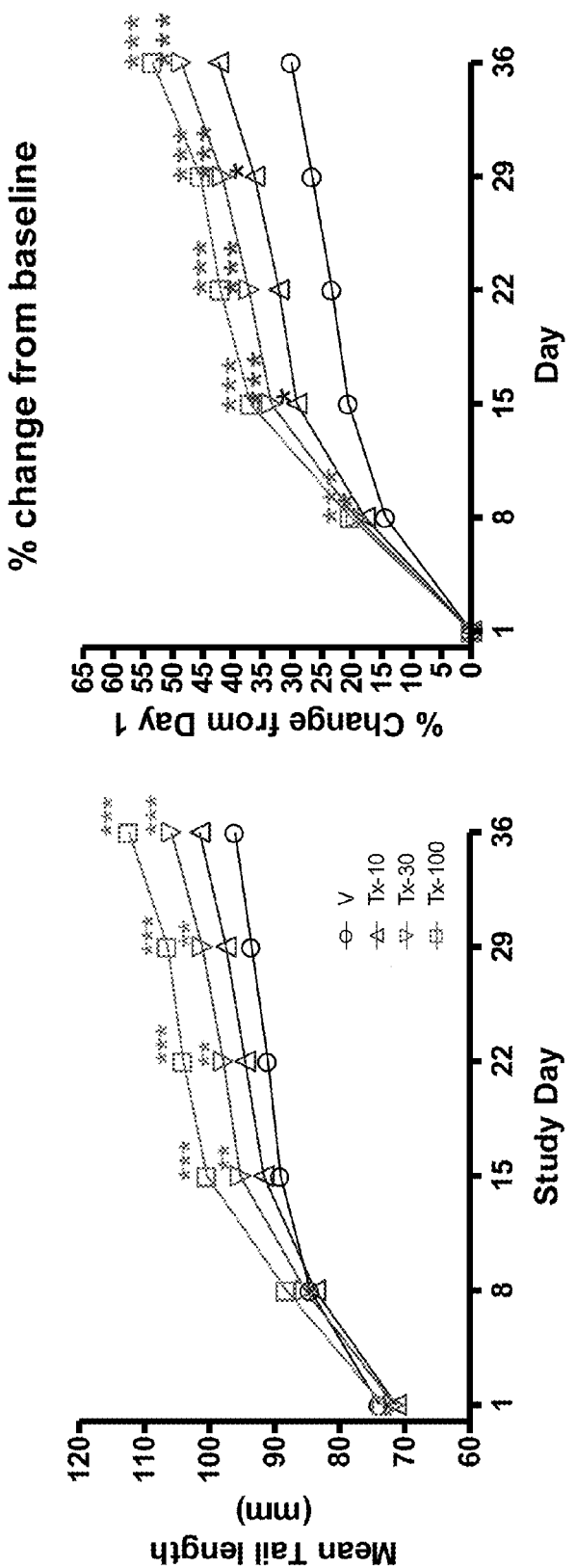
FIG. 33C Study in WT (CD-1) Mice: Mean Tail Length

Study in WT (CD-1) Mice: Tail Length at Day 36

Study in WT (CD-1) Mice: Mean Right Tibia Length

Study in WT (CD-1) Mice: Right Tibia Length at Day 36

Study in WT (CD-1) Mice: Average Body Weight

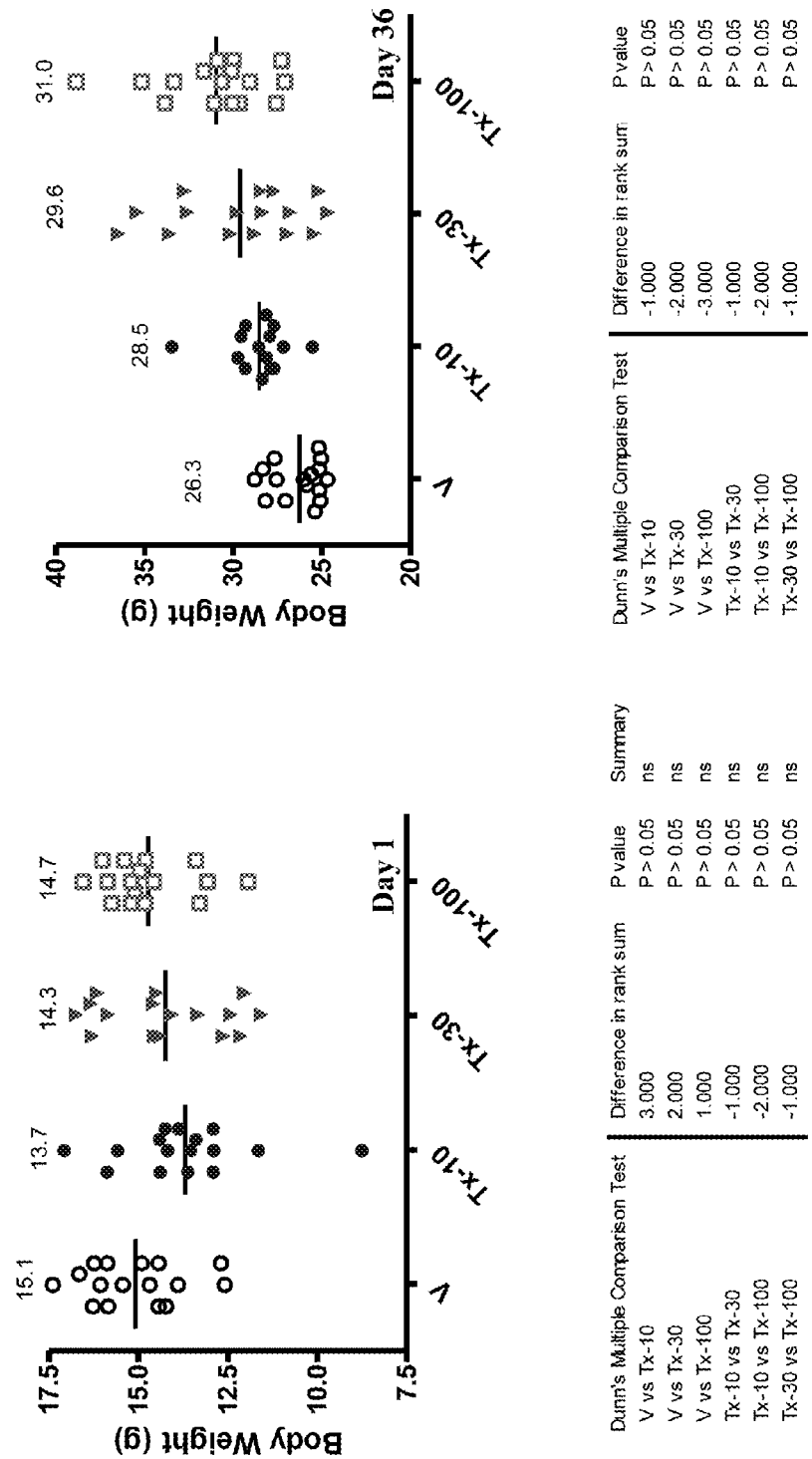
FIG. 33H Study in WT (CD-1) Mice: Body Weight at Days 1 and 36

Study in WT (CD-1) Mice: Left Femur Length

Study in WT (CD-1) Mice: Naso-Anal Length

Study in WT (CD-1) Mice: Ratio of Naso-Anal Length/Crown-Rump Length

Study in WT (CD-1) Mice: Total Cervical, Thoracic, and Lumbar (CTL) Length

Study in WT (CD-1) Mice: Cervical Vertebrae Length

Study in WT (CD-1) Mice: Thoracic Vertebrae Length

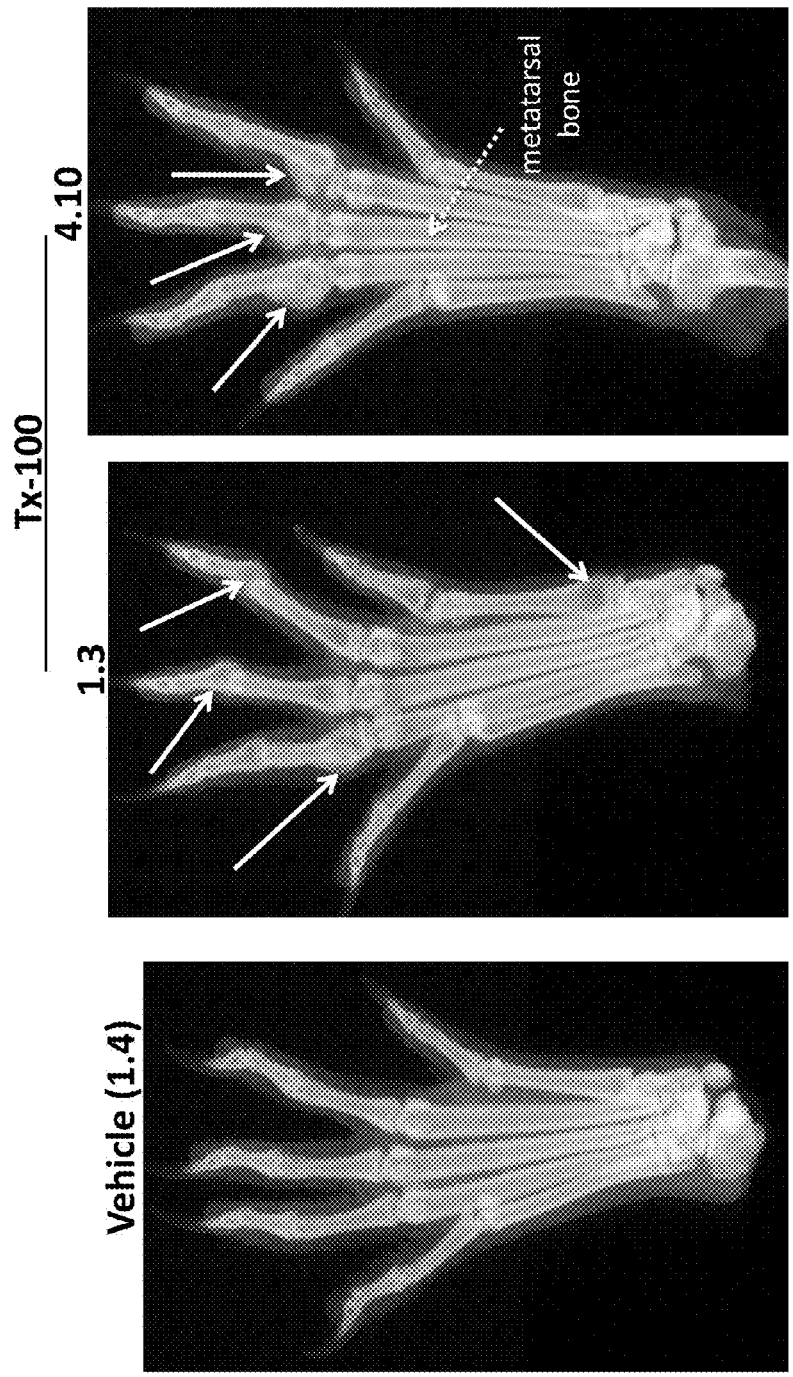
FIG. 33T Study in WT (CD-1) Mice: Faxitron feet (necropsy)

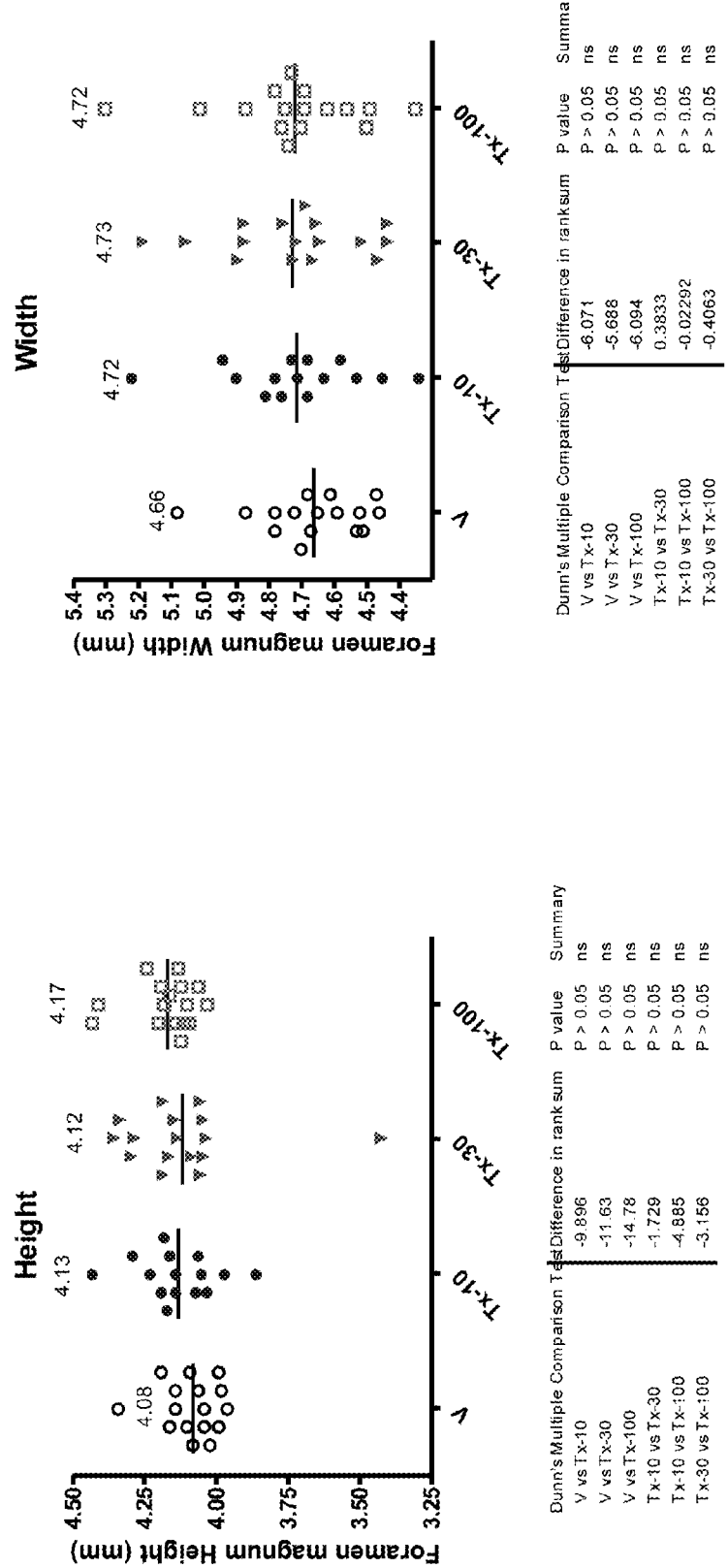
FIG. 33V Study in WT (CD-1) Mice: Foramen Magnum Height and Width

Study in WT (CD-1) Mice: Foramen Magnum Ratio of Width/ Height

Study in WT (CD-1) Mice: Skull Circularity Index

FIG. 34
CNP variants

```
CNP22                              GLSKGCFGLKLDRIGSMSGLGC                                      (SEQ ID NO: 4)
CNP-L17                            GLSKGCFGLKLDRIGSLSGLGC                                      (SEQ ID NO: 120)
CNP-F17                            GLSKGCFGLKLDRIGSFSGLGC                                      (SEQ ID NO: 119)
CNP-T17                            GLSKGCFGLKLDRIGSTSGLGC                                      (SEQ ID NO: 122)
D6-14AAlinker-CNP [C3]             DDDDDDGGGGSGGGGSGGGGSGLSKGCFGLKLDRIGSMSGLGC                 (SEQ ID NO: 147)
CNP-14AAlinker-D6 [C4]             GLSKGCFGLKLDRIGSMSGLGCGGGGSGGGGSGGGGDDDDDD                  (SEQ ID NO: 148)
CNP-Nterm2 [C5]                    ASTSPANPRPAASSGGLSKGCFGLKLDRIGSMSGLGC                       (SEQ ID NO: 150)
CDNP-S3A4A5R6 [C13]                GLSKGCFGLKLDRIGSMSGLGCPSSAARRPNAPSTSA                       (SEQ ID NO: 115)
CDNP29-S3A4A5R6 [C14]              GLSKGCFGLKLDRIGSMSGLGCPSSAARR                               (SEQ ID NO: 151)
C1(E6)   [BC1]                     EEEEEESGGGGSGGGGSGGGGGLSKGCFGLKLDRIGSMSGLGC                 (SEQ ID NO: 129)
C2(E6)   [BC2]                     EEEEEEASTSPANPQPAASSPGLSKGCFGLKLDRIGSMSGLGC                 (SEQ ID NO: 130)
C3(E6)   [BC3]                     EEEEEEPSSAAPQPNAPSTSAGLSKGCFGLKLDRIGSMSGLGC                 (SEQ ID NO: 131)
C4(E6)   [BC4]                     EEEEEESGGGGSGGGGSGGGGKGANKKGLSKGCFGLKLDRIGSMSGLGC           (SEQ ID NO: 132)
C5(E6)   [BC5]                     EEEEEESGGGGSGGGGSGGGQGANQQGLSKGCFGLKLDRIGSMSGLGC            (SEQ ID NO: 133)
C6(E6)   [BC6]                     EEEEEESGGGGSGGGGSGGGKGANKQGLSKGCFGLKLDRIGSMSGLGC            (SEQ ID NO: 134)
C7(E6)   [BC7]                     EEEEEESGGGGSGGGGSGGGKGANQKGLSKGCFGLKLDRIGSMSGLGC            (SEQ ID NO: 135)
C8(E6)   [BC8]                     EEEEEESGGGGSGGGGSGGGKGANKKGLSKGCFGLKLDRIGSMSGLGC            (SEQ ID NO: 136)
C9(E6)   [BC9]                     EEEEEESGGGGSGGGGSGGGQGANQQGLSKGCFGLKLDRIGSMSGLGC            (SEQ ID NO: 137)
C10(E6) [BC10]                     EEEEEESGGGGSGGGGSGGGQGANQKGLSKGCFGLKLDRIGSMSGLGC            (SEQ ID NO: 138)
C11(E6) [BC11]                     EEEEEESGGGGSGGGGSGGGKGANKGLSKGCFGLKLDRIGSMSGLGC             (SEQ ID NO: 139)
PGCNP37(E6)                        EEEEEEPGQEHPNARKYKGANKYKGANKGLSKGCFGLKLDRIGSMSGLGC          (SEQ ID NO: 128)
KA1                                HGPQGQEHPNARKYKGANKYKGANKGLSKGCFGLKLDRIGSMSGLGC             (SEQ ID NO: 152)
KA1(E6)                            EEEEEEHGPQGQEHPNARKYKGANKYKGANKGLSKGCFGLKLDRIGSMSGLGC       (SEQ ID NO: 153)
KB1                                HKLRGQEHPNARKYKGANKYKGANKGLSKGCFGLKLDRIGSMSGLGC             (SEQ ID NO: 154)
KB1(E6)                            EEEEEEHKLRGQEHPNARKYKGANKYKGANKGLSKGCFGLKLDRIGSMSGLGC       (SEQ ID NO: 155)
```

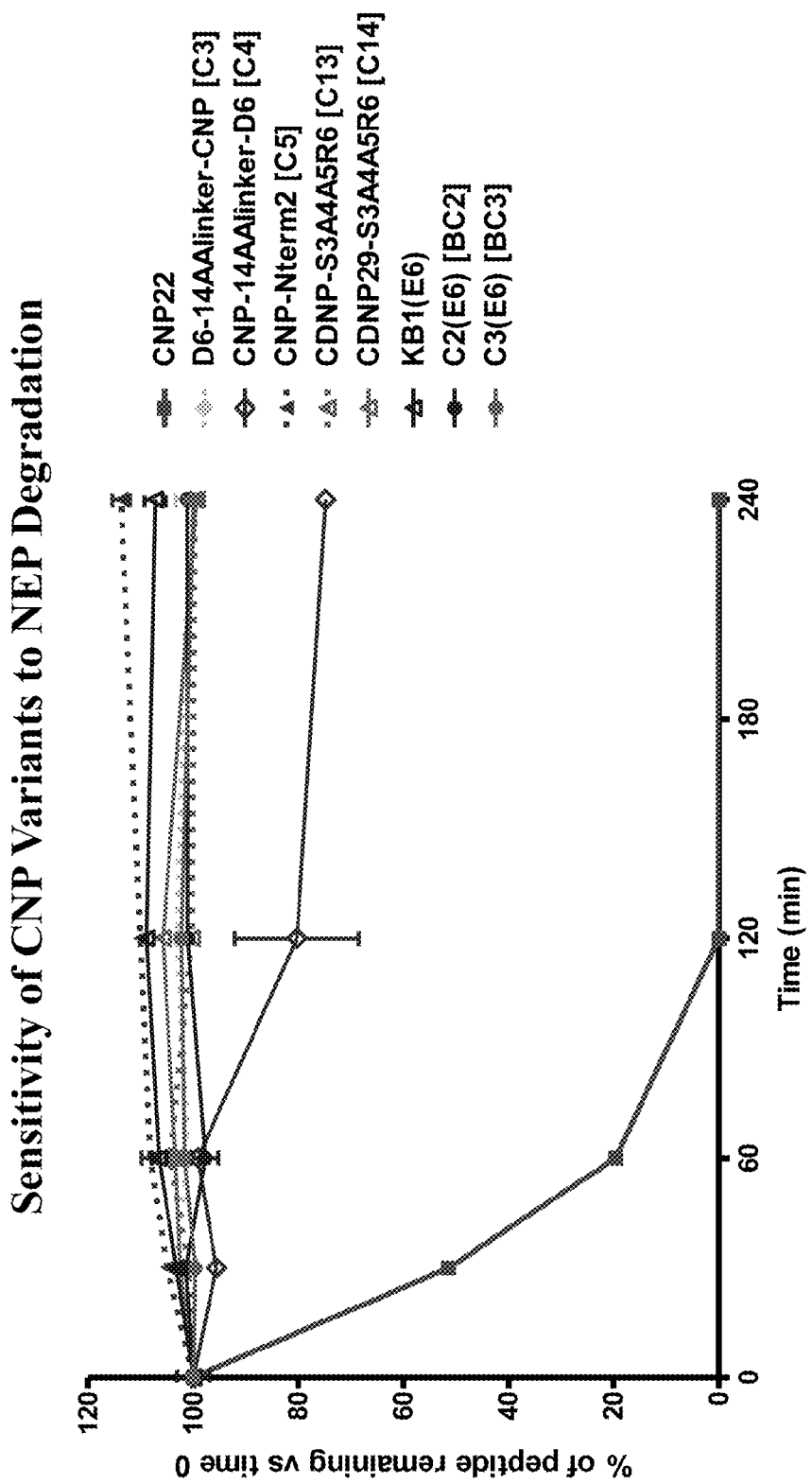

Dose-Response Assay: NPR-B Whole Cell cGMP Production

Dose-Response Assay: NPR-B Whole Cell cGMP Production

| Agonist | EC$_{50}$ (nM) | EC$_{50}$ ratio | % Efficacy | Rescue range (nM) (rescue ratio) |
|---|---|---|---|---|
| CNP22 | 14.7 | 1.0 | 100 | 2.4 – 14 |
| NC2B | 1089 | 74 | 120 | 135 – 761 (55x) |
| NC2B-L17 | 795 | 54 | 106 | 119 – 725 (51x) |
| NC2B (N=7) | 780 | 53 | 84 | 195 – 1196 (83 ± 21x) |

FIG. 38

CNP variants having Point Mutations at Position 17

| | | |
|---|---|---|
| CNP-X17 | GLSKGCFGLKLDRIGSXSGLGC | (SEQ ID NO: 126) |
| CNP-F17 | GLSKGCFGLKLDRIGSFSGLGC | (SEQ ID NO: 119) |
| CNP-L17 | GLSKGCFGLKLDRIGSLSGLGC | (SEQ ID NO: 120) |
| CNP-I17 | GLSKGCFGLKLDRIGSISGLGC | (SEQ ID NO: 121) |
| CNP-T17 | GLSKGCFGLKLDRIGSTSGLGC | (SEQ ID NO: 122) |
| CNP-E17 | GLSKGCFGLKLDRIGSESGLGC | (SEQ ID NO: 156) |
| CNP-R17 | GLSKGCFGLKLDRIGSRSGLGC | (SEQ ID NO: 157) |
| CNP-Y17 | GLSKGCFGLKLDRIGSYSGLGC | (SEQ ID NO: 158) |
| CNP-C17 | GLSKGCFGLKLDRIGSCSGLGC | (SEQ ID NO: 159) |
| CNP-P17 | GLSKGCFGLKLDRIGSPSGLGC | (SEQ ID NO: 160) |
| CNP-D17 | GLSKGCFGLKLDRIGSDSGLGC | (SEQ ID NO: 161) |
| CNP37-X17 | QEHPNARKYKGANKKGLSKGCFGLKLDRIGSXSGLGC | (SEQ ID NO: 162) |
| CNP37-F17 | QEHPNARKYKGANKKGLSKGCFGLKLDRIGSFSGLGC | (SEQ ID NO: 163) |
| CNP37-L17 | QEHPNARKYKGANKKGLSKGCFGLKLDRIGSLSGLGC | (SEQ ID NO: 164) |
| CNP37-I17 | QEHPNARKYKGANKKGLSKGCFGLKLDRIGSISGLGC | (SEQ ID NO: 165) |
| CNP37-T17 | QEHPNARKYKGANKKGLSKGCFGLKLDRIGSTSGLGC | (SEQ ID NO: 166) |
| CNP37-E17 | QEHPNARKYKGANKKGLSKGCFGLKLDRIGSESGLGC | (SEQ ID NO: 167) |
| CNP37-R17 | QEHPNARKYKGANKKGLSKGCFGLKLDRIGSRSGLGC | (SEQ ID NO: 168) |
| CNP37-Y17 | QEHPNARKYKGANKKGLSKGCFGLKLDRIGSYSGLGC | (SEQ ID NO: 169) |
| CNP37-C17 | QEHPNARKYKGANKKGLSKGCFGLKLDRIGSCSGLGC | (SEQ ID NO: 170) |
| CNP37-P17 | QEHPNARKYKGANKKGLSKGCFGLKLDRIGSPSGLGC | (SEQ ID NO: 171) |
| CNP37-D17 | QEHPNARKYKGANKKGLSKGCFGLKLDRIGSDSGLGC | (SEQ ID NO: 172) |

FIG. 39A

Additional CNP variants having Point Mutations at Position 17

| | | |
|---|---|---|
| KA1-X17 | HGPQGQEHPNARKYKGANKKGLSKGCFGLKLDRIGSXSGLGC | (SEQ ID NO: 173) |
| KA2-X17 | SGGGGHGPQGQEHPNARKYKGANKKGLSKGCFGLKLDRIGSXSGLGC | (SEQ ID NO: 174) |
| KA3-X17 | GGGHGPQGQEHPNARKYKGANKKGLSKGCFGLKLDRIGSXSGLGC | (SEQ ID NO: 175) |
| KA4-X17 | GGGSGGGGQEHPNARKYKGANKKGLSKGCFGLKLDRIGSXSGLGC | (SEQ ID NO: 176) |
| KA5-X17 | SGGGGSGGGGSGGGGSGGGGANKKGLSKGCFGLKLDRIGSXSGLGC | (SEQ ID NO: 177) |
| KA6-X17 | HGPQGSGGGSGGGKGANKKGLSKGCFGLKLDRIGSXSGLGC | (SEQ ID NO: 178) |
| KA7-X17 | GGGSGGGGSGGGGSGANKKGLSKGCFGLKLDRIGSXSGLGC | (SEQ ID NO: 179) |
| KA8-X17 | GGGHGPQGSGGGSGGGGKGANKKGLSKGCFGLKLDRIGSXSGLGC | (SEQ ID NO: 180) |
| KB1-X17 | HKLRGQEHPNARKYKGANKKGLSKGCFGLKLDRIGSXSGLGC | (SEQ ID NO: 181) |
| KB2-X17 | GGGHKLRGQEHPNARKYKGANKKGLSKGCFGLKLDRIGSXSGLGC | (SEQ ID NO: 182) |
| KB3-X17 | HKLRGSGGGSGGGGKGANKKGLSKGCFGLKLDRIGSXSGLGC | (SEQ ID NO: 183) |
| KB4-X17 | GGGHKLRGSGGGSGGGGKGANKKGLSKGCFGLKLDRIGSXSGLGC | (SEQ ID NO: 184) |
| PGCNP37-X17 | PGQEHPNARKYKGANKKGLSKGCFGLKLDRIGSXSGLGC | (SEQ ID NO: 185) |
| KA1(E6)-X17 | EEEEEEHGPQGQEHPNARKYKGANKKGLSKGCFGLKLDRIGSXSGLGC | (SEQ ID NO: 186) |
| KA2(E6)-X17 | EEEEEESGGGGHGPQGQEHPNARKYKGANKKGLSKGCFGLKLDRIGSXSGLGC | (SEQ ID NO: 187) |
| KA3(E6)-X17 | EEEEEEGGGHGPQGQEHPNARKYKGANKKGLSKGCFGLKLDRIGSXSGLGC | (SEQ ID NO: 188) |
| KA4(E6)-X17 | EEEEEEGGGSGGGGQEHPNARKYKGANKKGLSKGCFGLKLDRIGSXSGLGC | (SEQ ID NO: 189) |
| KA5(E6)-X17 | EEEEEESGGGGSGGGGSGGGGSGGGGANKKGLSKGCFGLKLDRIGSXSGLGC | (SEQ ID NO: 190) |
| KA6(E6)-X17 | EEEEEEHGPQGSGGGSGGGKGANKKGLSKGCFGLKLDRIGSXSGLGC | (SEQ ID NO: 191) |
| KA7(E6)-X17 | EEEEEEGGGSGGGGSGGGGSGANKKGLSKGCFGLKLDRIGSXSGLGC | (SEQ ID NO: 192) |
| KA8(E6)-X17 | EEEEEEGGGHGPQGSGGGSGGGGKGANKKGLSKGCFGLKLDRIGSXSGLGC | (SEQ ID NO: 193) |
| KB1(E6)-X17 | EEEEEEHKLRGQEHPNARKYKGANKKGLSKGCFGLKLDRIGSXSGLGC | (SEQ ID NO: 194) |
| KB2(E6)-X17 | EEEEEEGGGHKLRGQEHPNARKYKGANKKGLSKGCFGLKLDRIGSXSGLGC | (SEQ ID NO: 195) |
| KB3(E6)-X17 | EEEEEEHKLRGSGGGSGGGGKGANKKGLSKGCFGLKLDRIGSXSGLGC | (SEQ ID NO: 196) |
| KB4(E6)-X17 | EEEEEEGGGHKLRGSGGGSGGGGKGANKKGLSKGCFGLKLDRIGSXSGLGC | (SEQ ID NO: 197) |
| E6PGCNP37-X17 | EEEEEEPGQEHPNARKYKGANKKGLSKGCFGLKLDRIGSXSGLGC | (SEQ ID NO: 198) |

FIG. 39B

Additional CNP variants having Point Mutations at Position 17

| | | |
|---|---|---|
| C1(E6)-X17 | EEEEEESGGGGSGGGGSGGGGGLSKGCFGLKLDRIGSXSGLGC | (SEQ ID NO: 199) |
| C2(E6)-X17 | EEEEEEASTSPANPQPAASSPGLSKGCFGLKLDRIGSXSGLGC | (SEQ ID NO: 200) |
| C3(E6)-X17 | EEEEEEPSSAAPQPNAPSTSAGLSKGCFGLKLDRIGSXSGLGC | (SEQ ID NO: 201) |
| C4(E6)-X17 | EEEEEESGGGGSGGGGGANKKGLSKGCFGLKLDRIGSXSGLGC | (SEQ ID NO: 202) |
| C5(E6)-X17 | EEEEEESGGGGSGGGQGLSKGCFGLKLDRIGSXSGLGC | (SEQ ID NO: 203) |
| C6(E6)-X17 | EEEEEESGGGGSGGGGKGANKQGLSKGCFGLKLDRIGSXSGLGC | (SEQ ID NO: 204) |
| C7(E6)-X17 | EEEEEESGGGGSGGGGKGANKQGLSKGCFGLKLDRIGSXSGLGC | (SEQ ID NO: 205) |
| C8(E6)-X17 | EEEEEESGGGGSGGGQGGGKGANKKGLSKGCFGLKLDRIGSXSGLGC | (SEQ ID NO: 206) |
| C9(E6)-X17 | EEEEEESGGGGSGGGQGANQQGLSKGCFGLKLDRIGSXSGLGC | (SEQ ID NO: 207) |
| C10(E6)-X17 | EEEEEESGGGGSGGGQGANQKGLSKGCFGLKLDRIGSXSGLGC | (SEQ ID NO: 208) |
| C11(E6)-X17 | EEEEEESGGGGSGGGQGANKQGLSKGCFGLKLDRIGSXSGLGC | (SEQ ID NO: 209) |
| D6CNP37-X17 | DDDDDDQEHPNARKYKGANKKGLSKGCFGLKLDRIGSXSGLGC | (SEQ ID NO: 210) |
| C1(D6)-X17 | DDDDDDSGGGGSGGGGSGGGGGLSKGCFGLKLDRIGSXSGLGC | (SEQ ID NO: 211) |
| C2(D6)-X17 | DDDDDDASTSPANPQPAASSGGLSKGCFGLKLDRIGSXSGLGC | (SEQ ID NO: 212) |
| C3(D6)-X17 | DDDDDDGSSAAPQPNAPSTSAGLSKGCFGLKLDRIGSXSGLGC | (SEQ ID NO: 213) |
| C4(D6)-X17 | DDDDDDSGGGGSGGGGKGANKKGLSKGCFGLKLDRIGSXSGLGC | (SEQ ID NO: 214) |
| C5(D6)-X17 | DDDDDDSGGGGSGGGQGANQQGLSKGCFGLKLDRIGSXSGLGC | (SEQ ID NO: 215) |
| C6(D6)-X17 | DDDDDDSGGGGSGGGGKGANQKGLSKGCFGLKLDRIGSXSGLGC | (SEQ ID NO: 216) |
| D6-14AAlinker-CNP-X17 | DDDDDDGGGGSGGGGSGGGGGLSKGCFGLKLDRIGSXSGLGC | (SEQ ID NO: 217) |
| CNP-14AAlinker-D6-X17 | GLSKGCFGLKLDRIGSXSGLGCGGGGSGGGGSGGGGDDDDDD | (SEQ ID NO: 218) |
| CNP-Nterm1-X17 | GSSAAPRPNAPSTSAGLSKGCFGLKLDRIGSXSGLGC | (SEQ ID NO: 219) |
| CNP-Nterm2-X17 | ASTSPANPRPAASSGGLSKGCFGLKLDRIGSXSGLGC | (SEQ ID NO: 220) |

FIG. 40

CNP variants having M17L

| | | |
|---|---|---|
| KA1(E6)-L17 | EEEEEE*HGPQGQEH*PNARKYKGANKKGLSKGCFGLKLDRIGSLSGLGC | (SEQ ID NO: 221) |
| KA2(E6)-L17 | EEEEEE*SGGGG*PNARKYKGANKKGLSKGCFGLKLDRIGSLSGLGC | (SEQ ID NO: 222) |
| KA3(E6)-L17 | EEEEEE*GGGHGPQGQEH*PNARKYKGANKKGLSKGCFGLKLDRIGSLSGLGC | (SEQ ID NO: 223) |
| KA4(E6)-L17 | EEEEEE*GGGSGGGGQEH*PNARKYKGANKKGLSKGCFGLKLDRIGSLSGLGC | (SEQ ID NO: 224) |
| KA5(E6)-L17 | EEEEEE*SGGGSGGGGSGGGGK*GANKKGLSKGCFGLKLDRIGSLSGLGC | (SEQ ID NO: 225) |
| KA6(E6)-L17 | EEEEEE*HGPQGSGGGGSGGGGK*GANKKGLSKGCFGLKLDRIGSLSGLGC | (SEQ ID NO: 226) |
| KA7(E6)-L17 | EEEEEE*GGGSGGGGSGGGGSGGGGK*GLSKGCFGLKLDRIGSLSGLGC | (SEQ ID NO: 227) |
| KA8(E6)-L17 | EEEEEE*GGGHGPQGSGGGGSGGGGK*GLSKGCFGLKLDRIGSLSGLGC | (SEQ ID NO: 228) |
| KB1(E6)-L17 | EEEEEE*GGGHKLRG*QEHPNARKYKGANKKGLSKGCFGLKLDRIGSLSGLGC | (SEQ ID NO: 229) |
| KB2(E6)-L17 | EEEEEE*GGGHKLRG*SGGGGKGANKKGLSKGCFGLKLDRIGSLSGLGC | (SEQ ID NO: 230) |
| KB3(E6)-L17 | EEEEEE*GGGHKLRG*SGGGGSGGGGKGANKKGLSKGCFGLKLDRIGSLSGLGC | (SEQ ID NO: 231) |
| KB4(E6)-L17 | EEEEEE*GGGHKLRG*SGGGGSGGGGKGLSKGCFGLKLDRIGSLSGLGC | (SEQ ID NO: 232) |
| E6PGCNP37-L17 | EEEEEE *PGQEH*PNARKYKGANKKGLSKGCFGLKLDRIGSLSGLGC | (SEQ ID NO: 233) |

FIG. 41A

NC2st-X17 and NC2B-X17 Protein Sequences

NC2st-X17
(w/ sig. seq.)

MGVHECPAWLWLLLSLLSLWPGAYAASWSHPQFEQSGGGGGENLYFQGGDKTHTCPPCPAPELLGGPSVFLFP
PKPKDTLMISRTPEVTCVVVDVSHEDPEVKFNWYVDGVEVHNAKTKPREEQYNSTYRVVSVLTVLHQDWLNGK
EYKCKVSNKALPAPIEKTISKAKGQPREPQVYTLPPSREEMTKNQVSLTCLVKGFYPSDIAVEWESNGQPENN
YKTTPPVLDSDGSFFLYSKLTVDKSRWQQGNVFSCSVMHEALHNHYTQKSLSLSPGK*GGGGSGGGGSGGGGSG
GLSKGCFGLKLDRIGSXSGLCC* (SEQ ID NO: 527)

NC2st-X17
(w/o sig. seq.)

ASWSHPQFEQSGGGGGENLYFQGGDKTHTCPPCPAPELLGGPSVFLFPPKPKDTLMISRTPEVTCVVVDVSHE
DPEVKFNWYVDGVEVHNAKTKPREEQYNSTYRVVSVLTVLHQDWLNGKEYKCKVSNKALPAPIEKTISKAKGQ
PREPQVYTLPPSREEMTKNQVSLTCLVKGFYPSDIAVEWESNGQPENNYKTTPPVLDSDGSFFLYSKLTVDKS
RWQQGNVFSCSVMHEALHNHYTQKSLSLSPGK*GGGGSGGGGSGGGGSGGLSKGCFGLKLDRIGSXSGLCC*
(SEQ ID NO: 528)

NC2B-X17
(w/ sig. seq.)

MGVHECPAWLWLLLSLLSLWPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGK*GGGGSGGGGSGGGGSGGLSKGCFGLKLDRIGSXSGLCC*
(SEQ ID NO: 529)

NC2B-X17
(w/o sig. seq.)

DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
SLSLSPGK*GGGGSGGGGSGGGGSGGLSKGCFGLKLDRIGSXSGLCC* (SEQ ID NO: 530)

FIG. 41B

NC2B-22-X17, NC2B-28-X17, and NC2B-34-X17 Sequences

NC2B-22-X17
(w/sig. seq.)

MGVHECPAWLWLLLSLLSLWPGAYADKTHTCPPCPAPELLGGPSVFLFPPKPKDTLMISRTPEVTCVVVDVSH
EDPEVKFNWYVDGVEVHNAKTKPREEQYNSTYRVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGK*GGGGSGGGGSGGGGSGGGGSGGGGXXXXXXXX*
*XXXX* (SEQ ID NO: 531)

NC2B-22-X17
(w/o sig. seq.)

DKTHTCPPCPAPELLGGPSVFLFPPKPKDTLMISRTPEVTCVVVDVSHEDPEVKFNWYVDGVEVHNAKTKPRE
EQYNSTYRVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
SLSLSPGK*GGGGSGGGGSGGGGSGGGGSGGGGXXXXXXXXXXXX* (SEQ ID NO: 532)

NC2B-28-X17
(w/sig. seq.)

MGVHECPAWLWLLLSLLSLWPGAYADKTHTCPPCPAPELLGGPSVFLFPPKPKDTLMISRTPEVTCVVVDVSH
EDPEVKFNWYVDGVEVHNAKTKPREEQYNSTYRVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGK*GGGGSGGGGSGGGGSGGGGSGGGGXXXXXXXX*
*XXXXXXXX* (SEQ ID NO: 533)

NC2B-28-X17
(w/o sig. seq.)

DKTHTCPPCPAPELLGGPSVFLFPPKPKDTLMISRTPEVTCVVVDVSHEDPEVKFNWYVDGVEVHNAKTKPRE
EQYNSTYRVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
SLSLSPGK*GGGGSGGGGSGGGGSGGGGSGGGGXXXXXXXXXXXX* (SEQ ID NO:
534)

NC2B-34-X17
(w/sig. seq.)

MGVHECPAWLWLLLSLLSLWPGAYADKTHTCPPCPAPELLGGPSVFLFPPKPKDTLMISRTPEVTCVVVDVSH
EDPEVKFNWYVDGVEVHNAKTKPREEQYNSTYRVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGK*GGGGSGGGGSGGGGSGGGGSGGGGXXXXXXXX*
*XXXXXXXX* (SEQ ID NO: 535)

NC2B-34-X17
(w/o sig. seq.)

DKTHTCPPCPAPELLGGPSVFLFPPKPKDTLMISRTPEVTCVVVDVSHEDPEVKFNWYVDGVEVHNAKTKPRE
EQYNSTYRVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
SLSLSPGK*GGGGSGGGGSGGGGSGGGGSGGGGXXXXXXXXXXXX* (SEQ ID
NO: 536)

FIG. 41C
NC2-X17 Variants

NC2-KGANKK-X17 (w/sig. seq.)
MGVHECPAWLWLLLSLLSLMWPGAYADKTHTCPPCPAPELLGGPSVFLFPPKPKDTLMISRTPEVTCVVVDVSH EDPEVKFNWYVDGVEVHNAKTKPREEQYNSTYRVVSVLTVLHQDWLNGKEYKCKVSNKALPAPIEKTISKAKG QPREPQVYTLPPSREEMTKNQVSLTCLVKGFYPSDIAVEWESNGQPENNYKTTPPVLDSDGSFFLYSKLTVDK SRWQQGNVFSCSVMHEALHNHYTQKSLSLSPGK*GGGGSGGGGSKGANKK*GSKCFGIKHRIGCKISGKC (SEQ ID NO: 537)

NC2-KGANKK-X17 (w/o sig. seq.)
DKTHTCPPCPAPELLGGPSVFLFPPKPKDTLMISRTPEVTCVVVDVSHEDPEVKFNWYVDGVEVHNAKTKPRE EQYNSTYRVVSVLTVLHQDWLNGKEYKCKVSNKALPAPIEKTISKAKGQPREPQVYTLPPSREEMTKNQVSLT CLVKGFYPSDIAVEWESNGQPENNYKTTPPVLDSDGSFFLYSKLTVDKSRWQQGNVFSCSVMHEALHNHYTQK SLSLSPGK*GGGGSGGGGSKGANKK*GSKCFGIKHRIGCKISGKC (SEQ ID NO: 538)

NC2-KGANQK-X17 (w/sig. seq.)
MGVHECPAWLWLLLSLLSLMWPGAYADKTHTCPPCPAPELLGGPSVFLFPPKPKDTLMISRTPEVTCVVVDVSH EDPEVKFNWYVDGVEVHNAKTKPREEQYNSTYRVVSVLTVLHQDWLNGKEYKCKVSNKALPAPIEKTISKAKG QPREPQVYTLPPSREEMTKNQVSLTCLVKGFYPSDIAVEWESNGQPENNYKTTPPVLDSDGSFFLYSKLTVDK SRWQQGNVFSCSVMHEALHNHYTQKSLSLSPGK*GGGGSGGGGSKGANQK*GSKCFGIKHRIGCKISGKC (SEQ ID NO: 539)

NC2-KGANQK-X17 (w/o sig. seq.)
DKTHTCPPCPAPELLGGPSVFLFPPKPKDTLMISRTPEVTCVVVDVSHEDPEVKFNWYVDGVEVHNAKTKPRE EQYNSTYRVVSVLTVLHQDWLNGKEYKCKVSNKALPAPIEKTISKAKGQPREPQVYTLPPSREEMTKNQVSLT CLVKGFYPSDIAVEWESNGQPENNYKTTPPVLDSDGSFFLYSKLTVDKSRWQQGNVFSCSVMHEALHNHYTQK SLSLSPGK*GGGGSGGGGSKGANQK*GSKCFGIKHRIGCKISGKC (SEQ ID NO: 540)

NC2-CNP53mut2-X17 (w/sig. seq.)
MGVHECPAWLWLLLSLLSLMWPGAYADKTHTCPPCPAPELLGGPSVFLFPPKPKDTLMISRTPEVTCVVVDVSH EDPEVKFNWYVDGVEVHNAKTKPREEQYNSTYRVVSVLTVLHQDWLNGKEYKCKVSNKALPAPIEKTISKAKG QPREPQVYTLPPSREEMTKNQVSLTCLVKGFYPSDIAVEWESNGQPENNYKTTPPVLDSDGSFFLYSKLTVDK SRWQQGNVFSCSVMHEALHNHYTQKSLSLSPGK*GGGDLQVDTQSQAAWAQLLQEHPNAQQYKGANKK*GSKC FGIKHRIGCKISGKC (SEQ ID NO: 541)

NC2-CNP53mut2-X17 (w/o sig. seq.)
DKTHTCPPCPAPELLGGPSVFLFPPKPKDTLMISRTPEVTCVVVDVSHEDPEVKFNWYVDGVEVHNAKTKPRE EQYNSTYRVVSVLTVLHQDWLNGKEYKCKVSNKALPAPIEKTISKAKGQPREPQVYTLPPSREEMTKNQVSLT CLVKGFYPSDIAVEWESNGQPENNYKTTPPVLDSDGSFFLYSKLTVDKSRWQQGNVFSCSVMHEALHNHYTQK SLSLSPGK*GGGDLQVDTQSQAAWAQLLQEHPNAQQYKGANKK*GSKCFGIKHRIGCKISGKC (SEQ ID NO: 542)

FIG. 41D

Fc-CNP53-X17 Constructs

Fc-CNP53-X17 (w/sig. seq.)

MGVHECPAWLWLLLSLLSLWPGAYADKTHTCPPCPAPELLGGPSVFLFPPKPKDTLMISRTPEVTCVVVDVSH EDPEVKFNWYVDGVEVHNAKTKPREEQYNSTYRVVSVLTVLHQDWLNGKEYKCKVSNKALPAPIEKTISKAKG QPREPQVYTLPPSREEMTKNQVSLTCLVKGFYPSDIAVEWESNGQPENNYKTTPPVLDSDGSFFLYSKLTVDK SRWQQGNVFSCSVMHEALHNHYTQKSLSLSPGKGGGDLRVDTKSRAAWARLLQEHPNARKYKGANKKGLSKGC FGLKLDRIGSXSGLGC (SEQ ID NO: 543)

Fc-CNP53-X17 (w/o sig. seq.)

DKTHTCPPCPAPELLGGPSVFLFPPKPKDTLMISRTPEVTCVVVDVSHEDPEVKFNWYVDGVEVHNAKTKPRE EQYNSTYRVVSVLTVLHQDWLNGKEYKCKVSNKALPAPIEKTISKAKGQPREPQVYTLPPSREEMTKNQVSLT CLVKGFYPSDIAVEWESNGQPENNYKTTPPVLDSDGSFFLYSKLTVDKSRWQQGNVFSCSVMHEALHNHYTQK SLSLSPGKGGGDLRVDTKSRAAWARLLQEHPNARKYKGANKKGLSKGCFGLKLDRIGSXSGLGC (SEQ ID NO: 544)

Fc-CNP53-AA-X17 (w/sig. seq.)

MGVHECPAWLWLLLSLLSLWPGAYADKTHTCPPCPAPELLGGPSVFLFPPKPKDTLMISRTPEVTCVVVDVSH EDPEVKFNWYVDGVEVHNAKTKPREEQYNSTYRVVSVLTVLHQDWLNGKEYKCKVSNKALPAPIEKTISKAKG QPREPQVYTLPPSREEMTKNQVSLTCLVKGFYPSDIAVEWESNGQPENNYKTTPPVLDSDGSFFLYSKLTVDK SRWQQGNVFSCSVMHEALHNHYTQKSLSLSPGKGGGDLRVDTKSRAAWARLLQEHPNARKYKGANAAGLSKGC FGLKLDRIGSXSGLGC (SEQ ID NO: 545)

Fc-CNP53-AA-X17 (w/o sig. seq.)

DKTHTCPPCPAPELLGGPSVFLFPPKPKDTLMISRTPEVTCVVVDVSHEDPEVKFNWYVDGVEVHNAKTKPRE EQYNSTYRVVSVLTVLHQDWLNGKEYKCKVSNKALPAPIEKTISKAKGQPREPQVYTLPPSREEMTKNQVSLT CLVKGFYPSDIAVEWESNGQPENNYKTTPPVLDSDGSFFLYSKLTVDKSRWQQGNVFSCSVMHEALHNHYTQK SLSLSPGKGGGDLRVDTKSRAAWARLLQEHPNARKYKGANAAGLSKGCFGLKLDRIGSXSGLGC (SEQ ID NO: 546)

FIG. 41E

Constructs Having N-terminal NP-X17 fused to C-terminal Fc Domain

CNP-X17-16AAlinker-Fc-His₁₀ (NC1)
GLSKGCFGLKLDRIGSMSGLGCGGGGSGGGGSGGGGSGDKTHTCPPCPAPELLGGPSVFLFPPKPKDTLMISR
TPEVTCVVVDVSHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSD
GSFFLYSKLTVDKSRWQQGNVFSCSVMHEALHNHYTQKSLSLSPGKGGENLYFQGSHHHHHHHHHH (SEQ
ID NO: 547)

CNP-X17-6AAlinker-Fc-His₁₀ (NC3)
GLSKGCFGLKLDRIGSMSGLGCGGGGSGDKTHTCPPCPAPELLGGPSVFLFPPKPKDTLMISRTPEVTCVVVD
VSHEDPEVKFNWYVDGVEVHNAKTKPREEQYNSTYRVVSVLTVLHQDWLNGKEYKCKVSNKALPAPIEKTISK
AKGQPREPQVYTLPPSREEMTKNQVSLTCLVKGFYPSDIAVEWESNGQPENNYKTTPPVLDSDGSFFLYSKLT
VDKSRWQQGNVFSCSVMHEALHNHYTQKSLSLSPGKGGENLYFQGSHHHHHHHHHH(SEQ ID NO: 548)

CNP-X17-6AAlinker-Fc
GLSKGCFGLKLDRIGSMSGLGCGGGGSGDKTHTCPPCPAPELLGGPSVFLFPPKPKDTLMISRTPEVTCVVVD
VSHEDPEVKFNWYVDGVEVHNAKTKPREEQYNSTYRVVSVLTVLHQDWLNGKEYKCKVSNKALPAPIEKTISK
AKGQPREPQVYTLPPSREEMTKNQVSLTCLVKGFYPSDIAVEWESNGQPENNYKTTPPVLDSDGSFFLYSKLT
VDKSRWQQGNVFSCSVMHEALHNHYTQKSLSLSPGK(SEQ ID NO: 549)

CDNP-X17-Fc
SKGCFGLKLDRIGSMSGLGCSLKGCFGLKLDRIGSMSGLGCSTSADKTHTCPPCPAPELLGGPSVFLFPPKPKDTLMISRT
PEVTCVVVDVSHEDPEVKFNWYVDGVEVHNAKTKPREEQYNSTYRVVSVLTVLHQDWLNGKEYKCKVSNKALP
APIEKTISKAKGQPREPQVYTLPPSREEMTKNQVSLTCLVKGFYPSDIAVEWESNGQPENNYKTTPPVLDSDG
SFFLYSKLTVDKSRWQQGNVFSCSVMHEALHNHYTQKSLSLSPGK (SEQ ID NO: 550)

CDNP-X17-saa-Fc
SKGCFGLKLDRIGSMSGLGCSAAPENARSTSADKTHTCPPCPAPELLGGPSVFLFPPKPKDTLMISRT
PEVTCVVVDVSHEDPEVKFNWYVDGVEVHNAKTKPREEQYNSTYRVVSVLTVLHQDWLNGKEYKCKVSNKALP
APIEKTISKAKGQPREPQVYTLPPSREEMTKNQVSLTCLVKGFYPSDIAVEWESNGQPENNYKTTPPVLDSDG
SFFLYSKLTVDKSRWQQGNVFSCSVMHEALHNHYTQKSLSLSPGK (SEQ ID NO: 551)

CDNP-X17-sra-Fc
SKGCFGLKLDRIGSMSGLGCSRAPENARSTSADKTHTCPPCPAPELLGGPSVFLFPPKPKDTLMISRT
PEVTCVVVDVSHEDPEVKFNWYVDGVEVHNAKTKPREEQYNSTYRVVSVLTVLHQDWLNGKEYKCKVSNKALP
APIEKTISKAKGQPREPQVYTLPPSREEMTKNQVSLTCLVKGFYPSDIAVEWESNGQPENNYKTTPPVLDSDG
SFFLYSKLTVDKSRWQQGNVFSCSVMHEALHNHYTQKSLSLSPGK (SEQ ID NO: 552)

FIG. 42A
NC2 Variants

NC2-KGANKK
(w/sig. seq.)

MGVHECPAWLMLLLSLLSLMPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGK*GGGGSGGGGSGGGGSKGANK*KGSKGCFLLKLRIGSMSGLGC (SEQ ID NO: 511)

NC2-KGANKK
(w/o sig. seq.)

DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
SLSLSPGK*GGGGSGGGGSGGGGSKGANK*KGSKGCFLLKLRIGSMSGLGC (SEQ ID NO: 512)

NC2-KGANQK
(w/sig. seq.)

MGVHECPAWLMLLLSLLSLMPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGK*GGGGSGGGGSGGGGSKGANQ*KGSKGCFLLKLRIGSMSGLGC
(SEQ ID NO: 513)

NC2-KGANQK
(w/o sig. seq.)

DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
SLSLSPGK*GGGGSGGGGSGGGGSKGANQ*KGSKGCFLLKLRIGSMSGLGC (SEQ ID NO: 514)

NC2-CNP53mut2
(w/sig. seq.)

MGVHECPAWLMLLLSLLSLMPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGK*GGGDLQVDTQSQAAWAQLLQEHPNAQQYKGANKK*KGSKGC
(SEQ ID NO: 515)

NC2-CNP53mut2
(w/o sig. seq.)

DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
SLSLSPGK*GGGDLQVDTQSQAAWAQLLQEHPNAQQYKGANKK*KGSKGCFLLKLRIGSMSGLGC (SEQ ID NO: 516)

FIG. 42B
D10-NC2 Variants

D10-NC2-KGANKK (w/sig. seq.)

MGVHECPAWLWLLLSLLSLWPGAYADDDDDDDDDKTHTCPPCPAPELLGGPSVFLFPPKPKDTLMISRTPE
VTCVVVDVSHEDPEVKFNWYVDGVEVHNAKTKPREEQYNSTYRVVSVLTVLHQDWLNGKEYKCKVSNKALPAP
IEKTISKAKGQPREPQVYTLPPSREEMTKNQVSLTCLVKGFYPSDIAVEWESNGQPENNYKTTPPVLDSDGSF
FLYSKLTVDKSRWQQGNVFSCSVMHEALHNHYTQKSLSLSPGK*GGGGSGGGGSKGANKK*[illegible]
[illegible] (SEQ ID NO: 553)

D10-NC2-KGANKK (w/o sig. seq.)

DDDDDDDDDDKTHTCPPCPAPELLGGPSVFLFPPKPKDTLMISRTPEVTCVVVDVSHEDPEVKFNWYVDGVE
VHNAKTKPREEQYNSTYRVVSVLTVLHQDWLNGKEYKCKVSNKALPAPIEKTISKAKGQPREPQVYTLPPSRE
EMTKNQVSLTCLVKGFYPSDIAVEWESNGQPENNYKTTPPVLDSDGSFFLYSKLTVDKSRWQQGNVFSCSVMH
EALHNHYTQKSLSLSPGK*GGGGSGGGGSKGANKK*[illegible] (SEQ ID NO: 554)

D10-NC2-KGANQK (w/sig. seq.)

MGVHECPAWLWLLLSLLSLWPGAYADDDDDDDDDKTHTCPPCPAPELLGGPSVFLFPPKPKDTLMISRTPE
VTCVVVDVSHEDPEVKFNWYVDGVEVHNAKTKPREEQYNSTYRVVSVLTVLHQDWLNGKEYKCKVSNKALPAP
IEKTISKAKGQPREPQVYTLPPSREEMTKNQVSLTCLVKGFYPSDIAVEWESNGQPENNYKTTPPVLDSDGSF
FLYSKLTVDKSRWQQGNVFSCSVMHEALHNHYTQKSLSLSPGK*GGGGSGGGGSKGANQK*[illegible]
[illegible] (SEQ ID NO: 555)

D10-NC2-KGANQK (w/o sig. seq.)

DDDDDDDDDDKTHTCPPCPAPELLGGPSVFLFPPKPKDTLMISRTPEVTCVVVDVSHEDPEVKFNWYVDGVE
VHNAKTKPREEQYNSTYRVVSVLTVLHQDWLNGKEYKCKVSNKALPAPIEKTISKAKGQPREPQVYTLPPSRE
EMTKNQVSLTCLVKGFYPSDIAVEWESNGQPENNYKTTPPVLDSDGSFFLYSKLTVDKSRWQQGNVFSCSVMH
EALHNHYTQKSLSLSPGK*GGGGSGGGGSKGANQK*[illegible] (SEQ ID NO: 556)

D10-NC2-CNP53mut2 (w/sig. seq.)

MGVHECPAWLWLLLSLLSLWPGAYADDDDDDDDDKTHTCPPCPAPELLGGPSVFLFPPKPKDTLMISRTPE
VTCVVVDVSHEDPEVKFNWYVDGVEVHNAKTKPREEQYNSTYRVVSVLTVLHQDWLNGKEYKCKVSNKALPAP
IEKTISKAKGQPREPQVYTLPPSREEMTKNQVSLTCLVKGFYPSDIAVEWESNGQPENNYKTTPPVLDSDGSF
FLYSKLTVDKSRWQQGNVFSCSVMHEALHNHYTQKSLSLSPGK*GGGDLQVDTQSQAAWAQLLQEHPNAQQYKG
ANKK*[illegible] (SEQ ID NO: 557)

D10-NC2-CNP53mut2 (w/o sig. seq.)

DDDDDDDDDDKTHTCPPCPAPELLGGPSVFLFPPKPKDTLMISRTPEVTCVVVDVSHEDPEVKFNWYVDGVE
VHNAKTKPREEQYNSTYRVVSVLTVLHQDWLNGKEYKCKVSNKALPAPIEKTISKAKGQPREPQVYTLPPSRE
EMTKNQVSLTCLVKGFYPSDIAVEWESNGQPENNYKTTPPVLDSDGSFFLYSKLTVDKSRWQQGNVFSCSVMH
EALHNHYTQKSLSLSPGK*GGGDLQVDTQSQAAWAQLLQEHPNAQQYKGANKK*[illegible]
[illegible] (SEQ ID NO: 558)

FIG. 42C
NC2-F17 Variants

NC2-KGANKK-F17 (w/sig. seq.)
MGVHECPAWLWLLLSLLSLMWPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGK*GGGSGGGGSKGANKKISKGGTLKDRISSGLGC*
(SEQ ID NO: 559)

NC2-KGANKK-F17 (w/o sig. seq.)
DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
SLSLSPGK*GGGSGGGGSKGANKKISKGGTLKDRISSGLGC* (SEQ ID NO: 560)

NC2-KGANQK-F17 (w/sig. seq.)
MGVHECPAWLWLLLSLLSLMWPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGK*GGGSGGGGSKGANQKISKGGTLKDRISSGLGC* (SEQ ID NO: 561)

NC2-KGANQK-F17 (w/o sig. seq.)
DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
SLSLSPGK*GGGSGGGGSKGANQKISKGGTLKDRISSGLGC* (SEQ ID NO: 562)

NC2-CNP53mut2-F17 (w/sig. seq.)
MGVHECPAWLWLLLSLLSLMWPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGK*GGGDLQVDTQSQAAWAQLLQEHPNAQQYKGANKKISKGG
TLKDRISSGLGC* (SEQ ID NO: 563)

NC2-CNP53mut2-F17 (w/o sig. seq.)
DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
SLSLSPGK*GGGDLQVDTQSQAAWAQLLQEHPNAQQYKGANKKISKGGTLKDRISSGLGC* (SEQ ID NO: 564)

FIG. 42D
D10-NC2-F17 Variants

D10-NC2-KGANKK-F17 (w/sig. seq.)
MGVHECPAWLWLLLSLLSLWPGAYADDDDDDDDDKTHTCPPCPAPELLGGPSVFLFPPKPKDTLMISRTPE
VTCVVVDVSHEDPEVKFNWYVDGVEVHNAKTKPREEQYNSTYRVVSVLTVLHQDWLNGKEYKCKVSNKALPAP
IEKTISKAKGQPREPQVYTLPPSREEMTKNQVSLTCLVKGFYPSDIAVEWESNGQPENNYKTTPPVLDSDGSF
FLYSKLTVDKSRWQQGNVFSCSVMHEALHNHYTQKSLSLSPGKGGGGSGGGGSKGANK*********
****** (SEQ ID NO: 565)

D10-NC2-KGANKK-F17 (w/o sig. seq.)
DDDDDDDDDKTHTCPPCPAPELLGGPSVFLFPPKPKDTLMISRTPEVTCVVVDSHEDPEVKFNWYVDGVE
VHNAKTKPREEQYNSTYRVVSVLTVLHQDWLNGKEYKCKVSNKALPAPIEKTISKAKGQPREPQVYTLPPSRE
EMTKNQVSLTCLVKGFYPSDIAVEWESNGQPENNYKTTPPVLDSDGSFFLYSKLTVDKSRWQQGNVFSCSVMH
EALHNHYTQKSLSLSPGKGGGGSGGGGSKGANK*********** (SEQ ID NO: 566)

D10-NC2-KGANQK-F17 (w/sig. seq.)
MGVHECPAWLWLLLSLLSLWPGAYADDDDDDDDDKTHTCPPCPAPELLGGPSVFLFPPKPKDTLMISRTPE
VTCVVVDVSHEDPEVKFNWYVDGVEVHNAKTKPREEQYNSTYRVVSVLTVLHQDWLNGKEYKCKVSNKALPAP
IEKTISKAKGQPREPQVYTLPPSREEMTKNQVSLTCLVKGFYPSDIAVEWESNGQPENNYKTTPPVLDSDGSF
FLYSKLTVDKSRWQQGNVFSCSVMHEALHNHYTQKSLSLSPGKGGGGSGGGGSKGANQK*********
****** (SEQ ID NO: 567)

D10-NC2-KGANQK-F17 (w/o sig. seq.)
DDDDDDDDDKTHTCPPCPAPELLGGPSVFLFPPKPKDTLMISRTPEVTCVVVDSHEDPEVKFNWYVDGVE
VHNAKTKPREEQYNSTYRVVSVLTVLHQDWLNGKEYKCKVSNKALPAPIEKTISKAKGQPREPQVYTLPPSRE
EMTKNQVSLTCLVKGFYPSDIAVEWESNGQPENNYKTTPPVLDSDGSFFLYSKLTVDKSRWQQGNVFSCSVMH
EALHNHYTQKSLSLSPGKGGGGSGGGGSKGANQK*********** (SEQ ID NO: 568)

D10-NC2-CNP53mut2-F17 (w/sig. seq.)
MGVHECPAWLWLLLSLLSLWPGAYADDDDDDDDDKTHTCPPCPAPELLGGPSVFLFPPKPKDTLMISRTPE
VTCVVVDVSHEDPEVKFNWYVDGVEVHNAKTKPREEQYNSTYRVVSVLTVLHQDWLNGKEYKCKVSNKALPAP
IEKTISKAKGQPREPQVYTLPPSREEMTKNQVSLTCLVKGFYPSDIAVEWESNGQPENNYKTTPPVLDSDGSF
FLYSKLTVDKSRWQQGNVFSCSVMHEALHNHYTQKSLSLSPGKGGGDLQVDTQSQAAWAQLLQEHPNAQQYKG
ANK************* (SEQ ID NO: 569)

D10-NC2-CNP53mut2-F17 (w/o sig. seq.)
DDDDDDDDDKTHTCPPCPAPELLGGPSVFLFPPKPKDTLMISRTPEVTCVVVDSHEDPEVKFNWYVDGVE
VHNAKTKPREEQYNSTYRVVSVLTVLHQDWLNGKEYKCKVSNKALPAPIEKTISKAKGQPREPQVYTLPPSRE
EMTKNQVSLTCLVKGFYPSDIAVEWESNGQPENNYKTTPPVLDSDGSFFLYSKLTVDKSRWQQGNVFSCSVMH
EALHNHYTQKSLSLSPGKGGGDLQVDTQSQAAWAQLLQEHPNAQQYKGANK********
* (SEQ ID NO: 570)

FIG. 42E
NC2-L17 Variants

NC2-KGANKK-L17 (w/ sig. seq.)
MGVHECPAWLWLLLSLLSLWPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGK*GGGSGGGGSKGANKK*GSKGTGKKDRIGSSGHC (SEQ ID NO: 571)

NC2-KGANKK-L17 (w/o sig. seq.)
DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
SLSLSPGK*GGGSGGGGSKGANKK*GSKGTGKKDRIGSSGHC (SEQ ID NO: 572)

NC2-KGANQK-L17 (w/ sig. seq.)
MGVHECPAWLWLLLSLLSLWPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGK*GGGSGGGGSKGANQK*GSKGTGKKDRIGSSGHC (SEQ ID NO: 573)

NC2-KGANQK-L17 (w/o sig. seq.)
DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
SLSLSPGK*GGGSGGGGSKGANQK*GSKGTGKKDRIGSSGHC (SEQ ID NO: 574)

NC2-CNP53mut2-L17 (w/ sig. seq.)
MGVHECPAWLWLLLSLLSLWPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGK*GGGDLQVDTQSQAAWAQLLQEHPNAQQYKGANKK*GSKGTGKKDRIGSSGHC (SEQ ID NO: 575)

NC2-CNP53mut2-L17 (w/o sig. seq.)
DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
SLSLSPGK*GGGDLQVDTQSQAAWAQLLQEHPNAQQYKGANKK*GSKGTGKKDRIGSSGHC (SEQ ID NO: 576)

FIG. 42F
D10-NC2-L17 Variants

D10-NC2-KGANKK-L17 (w/ sig. seq.)
MGVHECPAWLWLLLSLLMPGAYADDDDDDDDDKTHTCPPCPAPELLGGPSVFLFPPKPKDTLMISRTPE
VTCVVVDVSHEDPEVKFNWYVDGVEVHNAKTKPREEQYNSTYRVVSVLTVLHQDWLNGKEYKCKVSNKALPAP
IEKTISKAKGQPREPQVYTLPPSREEMTKNQVSLTCLVKGFYPSDIAVEWESNGQPENNYKTTPPVLDGSF
FLYSKLTVDKSRWQQGNVFSCSVMHEALHNHYTQKSLSLSPGK*GGGGSGGGGSKGANKK*GSTGSTGSGG*KLLK*
*GSTSGTGS* (SEQ ID NO: 577)

D10-NC2-KGANKK-L17 (w/o sig. seq.)
DDDDDDDDDKTHTCPPCPAPELLGGPSVFLFPPKPKDTLMISRTPEVTCVVVDVSHEDPEVKFNWYVDGVE
VHNAKTKPREEQYNSTYRVVSVLTVLHQDWLNGKEYKCKVSNKALPAPIEKTISKAKGQPREPQVYTLPPSRE
EMTKNQVSLTCLVKGFYPSDIAVEWESNGQPENNYKTTPPVLDSDGSFFLYSKLTVDKSRWQQGNVFSCSVMH
EALHNHYTQKSLSLSPGK*GGGGSGGGGSKGANKK*GSTGSTGSGG*KLLK*GSTSGTGS* (SEQ ID NO: 578)

D10-NC2-KGANQK-L17 (w/ sig. seq.)
MGVHECPAWLWLLLSLLMPGAYADDDDDDDDDKTHTCPPCPAPELLGGPSVFLFPPKPKDTLMISRTPE
VTCVVVDVSHEDPEVKFNWYVDGVEVHNAKTKPREEQYNSTYRVVSVLTVLHQDWLNGKEYKCKVSNKALPAP
IEKTISKAKGQPREPQVYTLPPSREEMTKNQVSLTCLVKGFYPSDIAVEWESNGQPENNYKTTPPVLDSDGSF
FLYSKLTVDKSRWQQGNVFSCSVMHEALHNHYTQKSLSLSPGK*GGGGSGGGGSKGANQK*GSTGSTGSGG*KLLK*
*GSTSGTGS* (SEQ ID NO: 579)

D10-NC2-KGANQK-L17 (w/o sig. seq.)
DDDDDDDDDKTHTCPPCPAPELLGGPSVFLFPPKPKDTLMISRTPEVTCVVVDVSHEDPEVKFNWYVDGVE
VHNAKTKPREEQYNSTYRVVSVLTVLHQDWLNGKEYKCKVSNKALPAPIEKTISKAKGQPREPQVYTLPPSRE
EMTKNQVSLTCLVKGFYPSDIAVEWESNGQPENNYKTTPPVLDSDGSFFLYSKLTVDKSRWQQGNVFSCSVMH
EALHNHYTQKSLSLSPGK*GGGGSGGGGSKGANQK*GSTGSTGSGG*KLLK*GSTSGTGS* (SEQ ID NO: 580)

D10-NC2-CNP53mut2-L17 (w/ sig. seq.)
MGVHECPAWLWLLLSLLMPGAYADDDDDDDDDKTHTCPPCPAPELLGGPSVFLFPPKPKDTLMISRTPE
VTCVVVDVSHEDPEVKFNWYVDGVEVHNAKTKPREEQYNSTYRVVSVLTVLHQDWLNGKEYKCKVSNKALPAP
IEKTISKAKGQPREPQVYTLPPSREEMTKNQVSLTCLVKGFYPSDIAVEWESNGQPENNYKTTPPVLDSDGSF
FLYSKLTVDKSRWQQGNVFSCSVMHEALHNHYTQKSLSLSPGK*GGGDLQVDTQSQAAWAQLLQEHPNAQQYKG
ANKK*GSTGSCGIK*GSTGKLLK*DRIGS*SGLGG* (SEQ ID NO: 581)

D10-NC2-CNP53mut2-L17 (w/o sig. seq.)
DDDDDDDDDKTHTCPPCPAPELLGGPSVFLFPPKPKDTLMISRTPEVTCVVVDVSHEDPEVKFNWYVDGVE
VHNAKTKPREEQYNSTYRVVSVLTVLHQDWLNGKEYKCKVSNKALPAPIEKTISKAKGQPREPQVYTLPPSRE
EMTKNQVSLTCLVKGFYPSDIAVEWESNGQPENNYKTTPPVLDSDGSFFLYSKLTVDKSRWQQGNVFSCSVMH
EALHNHYTQKSLSLSPGK*GGGDLQVDTQSQAAWAQLLQEHPNAQQYKGANKK*GSTGSCGIK*GSTGKLLK*DRIGS*
*SGLGG* (SEQ ID NO: 582)

FIG. 42G
NC2-R17 Variants

NC2-KGANKK-R17 (w/sig. seq.)
MGVHECPAWLMLLLSLLSLWPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPKG*GGGSGGGGS*KGANKK*LSKGCELSKGDRIGSRSGLGC*
(SEQ ID NO: 583)

NC2-KGANKK-R17 (w/o sig. seq.)
DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
SLSLSPKG*GGGSGGGGS*KGANKK*LSKGCELSKGDRIGSRSGLGC* (SEQ ID NO: 584)

NC2-KGANQK-R17 (w/sig. seq.)
MGVHECPAWLMLLLSLLSLWPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPKG*GGGSGGGGS*KGANQK*LSKGCELSKGDRIGSRSGLGC*
(SEQ ID NO: 585)

NC2-KGANQK-R17 (w/o sig. seq.)
DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
SLSLSPKG*GGGSGGGGS*KGANQK*LSKGCELSKGDRIGSRSGLGC* (SEQ ID NO: 586)

NC2-CNP53mut2-R17 (w/sig. seq.)
MGVHECPAWLMLLLSLLSLWPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPKG*GGDLQVDTQSQAAWAQLLQEHPNAQQYKGANKKLSKGC*
*ELSKGDRIGSRSGLGC* (SEQ ID NO: 587)

NC2-CNP53mut2-R17 (w/o sig. seq.)
DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
SLSLSPKG*GGDLQVDTQSQAAWAQLLQEHPNAQQYKGANKKLSKGCELSKGDRIGSRSGLGC* (SEQ ID NO: 588)

FIG. 42H
D10-NC2-R17 Variants

D10-NC2-KGANKK-R17 (w/sig. seq.)
MGVHECPAWLMLLLSLLSLMPGAYADDDDDDDDDKTHTCPPCPAPELLGGPSVFLFPPKPKDTLMISRTPE
VTCVVVDVSHEDPEVKFNWYVDGVEVHNAKTKPREEQYNSTYRVVSVLTVLHQDWLNGKEYKCKVSNKALPAP
IEKTISKAKGQPREPQVYTLPPSREEMTKNQVSLTCLVKGFYPSDIAVEWESNGQPENNYKTTPPVLDSDGSF
FLYSKLTVDKSRWQQGNVFSCSVMHEALHNHYTQKSLSLSPGK*GGGGSGGGGSKGANK*::::::::::::::::::
::::::::::: (SEQ ID NO: 589)

D10-NC2-KGANKK-R17 (w/o sig. seq.)
DDDDDDDDDDKTHTCPPCPAPELLGGPSVFLFPPKPKDTLMISRTPEVTCVVVDVSHEDPEVKFNWYVDGVE
VHNAKTKPREEQYNSTYRVVSVLTVLHQDWLNGKEYKCKVSNKALPAPIEKTISKAKGQPREPQVYTLPPSRE
EMTKNQVSLTCLVKGFYPSDIAVEWESNGQPENNYKTTPPVLDSDGSFFLYSKLTVDKSRWQQGNVFSCSVMH
EALHNHYTQKSLSLSPGK*GGGGSGGGGSKGANK*:::::::::::::::::::::::: (SEQ ID NO: 590)

D10-NC2-KGANQK-R17 (w/sig. seq.)
MGVHECPAWLMLLLSLLSLMPGAYADDDDDDDDDKTHTCPPCPAPELLGGPSVFLFPPKPKDTLMISRTPE
VTCVVVDVSHEDPEVKFNWYVDGVEVHNAKTKPREEQYNSTYRVVSVLTVLHQDWLNGKEYKCKVSNKALPAP
IEKTISKAKGQPREPQVYTLPPSREEMTKNQVSLTCLVKGFYPSDIAVEWESNGQPENNYKTTPPVLDSDGSF
FLYSKLTVDKSRWQQGNVFSCSVMHEALHNHYTQKSLSLSPGK*GGGGSGGGGSKGANQK*::::::::::::
:::::: (SEQ ID NO: 591)

D10-NC2-KGANQK-R17 (w/o sig. seq.)
DDDDDDDDDDKTHTCPPCPAPELLGGPSVFLFPPKPKDTLMISRTPEVTCVVVDVSHEDPEVKFNWYVDGVE
VHNAKTKPREEQYNSTYRVVSVLTVLHQDWLNGKEYKCKVSNKALPAPIEKTISKAKGQPREPQVYTLPPSRE
EMTKNQVSLTCLVKGFYPSDIAVEWESNGQPENNYKTTPPVLDSDGSFFLYSKLTVDKSRWQQGNVFSCSVMH
EALHNHYTQKSLSLSPGK*GGGGSGGGGSKGANQK*:::::::::::::::::::::::: (SEQ ID NO: 592)

D10-NC2-CNP53mut2-R17 (w/sig. seq.)
MGVHECPAWLMLLLSLLSLMPGAYADDDDDDDDDKTHTCPPCPAPELLGGPSVFLFPPKPKDTLMISRTPE
VTCVVVDVSHEDPEVKFNWYVDGVEVHNAKTKPREEQYNSTYRVVSVLTVLHQDWLNGKEYKCKVSNKALPAP
IEKTISKAKGQPREPQVYTLPPSREEMTKNQVSLTCLVKGFYPSDIAVEWESNGQPENNYKTTPPVLDSDGSF
FLYSKLTVDKSRWQQGNVFSCSVMHEALHNHYTQKSLSLSPGK*GGGDLQVDTQSQAAWAQLLQEHPNAQQYKG
ANKK*:::::::::::::::::::::::: (SEQ ID NO: 593)

D10-NC2-CNP53mut2-R17 (w/o sig. seq.)
DDDDDDDDDDKTHTCPPCPAPELLGGPSVFLFPPKPKDTLMISRTPEVTCVVVDVSHEDPEVKFNWYVDGVE
VHNAKTKPREEQYNSTYRVVSVLTVLHQDWLNGKEYKCKVSNKALPAPIEKTISKAKGQPREPQVYTLPPSRE
EMTKNQVSLTCLVKGFYPSDIAVEWESNGQPENNYKTTPPVLDSDGSFFLYSKLTVDKSRWQQGNVFSCSVMH
EALHNHYTQKSLSLSPGK*GGGDLQVDTQSQAAWAQLLQEHPNAQQYKGANKK*:::::::::::::::::::
: (SEQ ID NO: 594)

FIG. 42I
NC2-Y17 Variants

NC2-KGANKK-Y17 (w/sig. seq.)
MGVHECPAWLWLLLSLLSLWPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGK*GGGGSGGGGSKGANKK*SKG*GTFLDRIGSISGIGG
(SEQ ID NO: 595)

NC2-KGANKK-Y17 (w/o sig. seq.)
DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
SLSLSPGK*GGGGSGGGGSKGANKK*SKG*GTFLDRIGSISGIGG (SEQ ID NO: 596)

NC2-KGANQK-Y17 (w/sig. seq.)
MGVHECPAWLWLLLSLLSLWPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGK*GGGGSGGGGSKGANQK*SKG*GTFLDRIGSISGIGG
(SEQ ID NO: 597)

NC2-KGANQK-Y17 (w/o sig. seq.)
DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
SLSLSPGK*GGGGSGGGGSKGANQK*SKG*GTFLDRIGSISGIGG (SEQ ID NO: 598)

NC2-CNP53mut2-Y17 (w/sig. seq.)
MGVHECPAWLWLLLSLLSLWPGAYADKTHTCPPCPAPELLGGPSVFLFPPKPKDTLMISRTPEVTCVVVDVSH
EDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTVDK
SRWQQGNVFSCSVMHEALHNHYTQKSLSLSPGK*GGGDLQVDTQSQAAWAQLLQEHPNAQQYKGANKK*SKG*
GTFLDRIGSISGIGG (SEQ ID NO: 599)

NC2-CNP53mut2-Y17 (w/o sig. seq.)
DKTHTCPPCPAPELLGGPSVFLFPPKPKDTLMISRTPEVTCVVVDVSHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQK
SLSLSPGK*GGGDLQVDTQSQAAWAQLLQEHPNAQQYKGANKK*SKG*GTFLDRIGSISGIGG (SEQ ID NO: 600)

FIG. 42J
D10-NC2-Y17 Variants

D10-NC2-KGANKK-Y17 (w/sig. seq.)
MGVHECPAWLMLLLSLSLWPGAYADDDDDDDDDKTHTCPPCPAPELLGGPSVFLFPPKDTLMISRTPE
VTCVVVDVSHEDPEVKFNWYVDGVEVHNYTKPREEQYNSTYRVVSVLTVLHQDWLNGKEYKCKVSNKALPAP
IEKTISKAKGQPREPQVYTLPPSREEMTKNQVSLTCLVKGFYPSDIAVEWESNGQPENNYKTTPPVLDSDGSF
FLYSKLTVDKSRWQQGNVFSCSVMHEALHNHYTQKSLSLSPGKGGGGSGGGGSKGANKK▓▓▓▓▓▓▓▓▓▓
▓▓▓▓▓▓ (SEQ ID NO: 601)

D10-NC2-KGANKK-Y17 (w/o sig. seq.)
DDDDDDDDDKTHTCPPCPAPELLGGPSVFLFPPKDTLMISRTPEVTCVVVDVSHEDPEVKFNWYVDGVE
VHNAKTKPREEQYNSTYRVVSVLTVLHQDWLNGKEYKCKVSNKALPAPIEKTISKAKGQPREPQVYTLPPSRE
EMTKNQVSLTCLVKGFYPSDIAVEWESNGQPENNYKTTPPVLDSDGSFFLYSKLTVDKSRWQQGNVFSCSVMH
EALHNHYTQKSLSLSPGKGGGGSGGGGSKGANKK▓▓▓▓▓▓▓▓▓▓▓▓▓▓▓▓ (SEQ ID NO: 602)

D10-NC2-KGANQK-Y17 (w/sig. seq.)
MGVHECPAWLMLLLSLSLWPGAYADDDDDDDDDKTHTCPPCPAPELLGGPSVFLFPPKDTLMISRTPE
VTCVVVDVSHEDPEVKFNWYVDGVEVHNAKTKPREEQYNSTYRVVSVLTVLHQDWLNGKEYKCKVSNKALPAP
IEKTISKAKGQPREPQVYTLPPSREEMTKNQVSLTCLVKGFYPSDIAVEWESNGQPENNYKTTPPVLDSDGSF
FLYSKLTVDKSRWQQGNVFSCSVMHEALHNHYTQKSLSLSPGKGGGGSGGGGSKGANQK▓▓▓▓▓▓▓▓▓▓
▓▓▓▓▓▓ (SEQ ID NO: 603)

D10-NC2-KGANQK-Y17 (w/o sig. seq.)
DDDDDDDDDKTHTCPPCPAPELLGGPSVFLFPPKDTLMISRTPEVTCVVVDVSHEDPEVKFNWYVDGVE
VHNAKTKPREEQYNSTYRVVSVLTVLHQDWLNGKEYKCKVSNKALPAPIEKTISKAKGQPREPQVYTLPPSRE
EMTKNQVSLTCLVKGFYPSDIAVEWESNGQPENNYKTTPPVLDSDGSFFLYSKLTVDKSRWQQGNVFSCSVMH
EALHNHYTQKSLSLSPGKGGGGSGGGGSKGANQK▓▓▓▓▓▓▓▓▓▓▓▓▓▓▓▓ (SEQ ID NO: 604)

D10-NC2-CNP53mut2-Y17 (w/sig. seq.)
MGVHECPAWLMLLLSLSLWPGAYADDDDDDDDDKTHTCPPCPAPELLGGPSVFLFPPKDTLMISRTPE
VTCVVVDVSHEDPEVKFNWYVDGVEVHNAKTKPREEQYNSTYRVVSVLTVLHQDWLNGKEYKCKVSNKALPAP
IEKTISKAKGQPREPQVYTLPPSREEMTKNQVSLTCLVKGFYPSDIAVEWESNGQPENNYKTTPPVLDSDGSF
FLYSKLTVDKSRWQQGNVFSCSVMHEALHNHYTQKSLSLSPGK*GGGDLQVDTQSQAAWAQLLQEHPNAQQYKG*
ANKK▓▓▓▓▓▓▓▓▓▓▓▓▓▓▓▓ (SEQ ID NO: 605)

D10-NC2-CNP53mut2-Y17 (w/o sig. seq.)
DDDDDDDDDKTHTCPPCPAPELLGGPSVFLFPPKDTLMISRTPEVTCVVVDVSHEDPEVKFNWYVDGVE
VHNAKTKPREEQYNSTYRVVSVLTVLHQDWLNGKEYKCKVSNKALPAPIEKTISKAKGQPREPQVYTLPPSRE
EMTKNQVSLTCLVKGFYPSDIAVEWESNGQPENNYKTTPPVLDSDGSFFLYSKLTVDKSRWQQGNVFSCSVMH
EALHNHYTQKSLSLSPGK*GGGDLQVDTQSQAAWAQLLQEHPNAQQYKGANKK*▓▓▓▓▓▓▓▓▓▓▓▓▓▓▓
▓ (SEQ ID NO: 606)

Hemodynamic Dose-Response Effects of NC2B

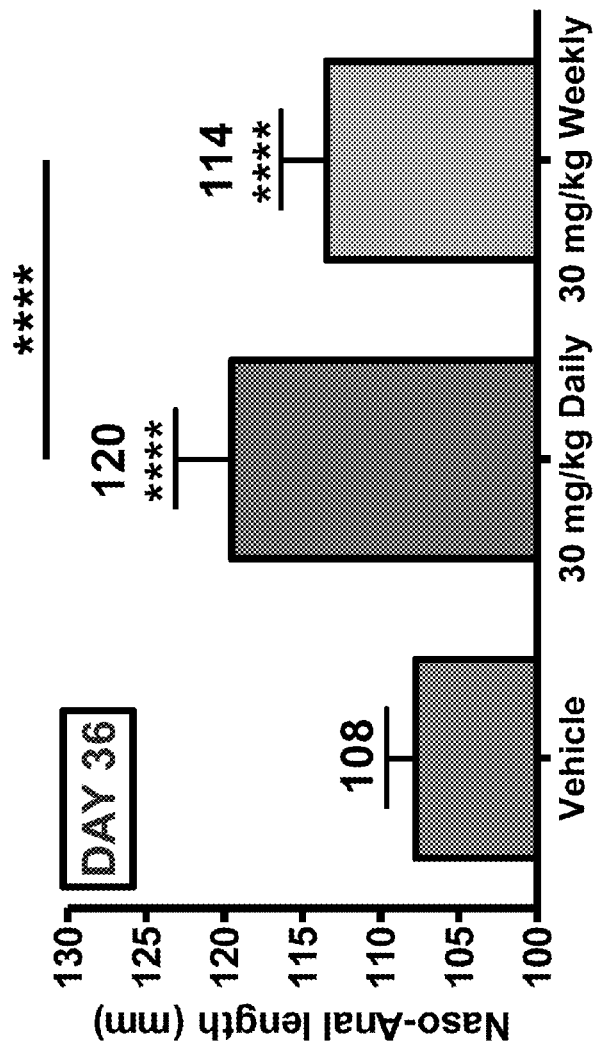

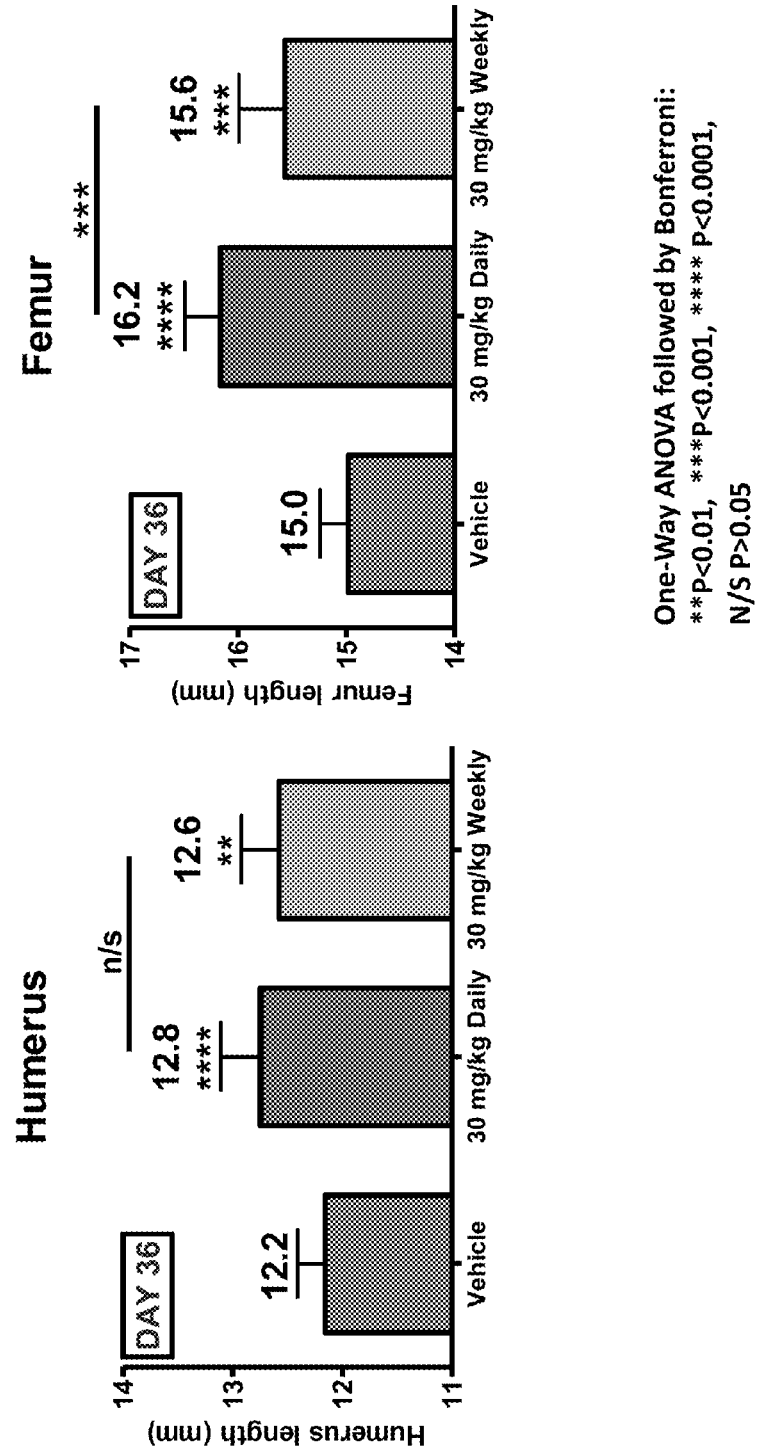
FIG. 44B Dosing Study in WT Mice: Humerus and Femur Length (caliper measurements)

COMPOSITIONS COMPRISING NATRIURETIC PEPTIDES AND METHODS OF USE THEREOF

CROSS REFERENCE TO RELATED APPLICATIONS

This application claims the benefit of the filing date of U.S. Provisional Patent Application No. 61/427,365, filed Dec. 27, 2010, and U.S. Provisional Patent Application No. 61/524,155, filed Aug. 16, 2011, each of which is incorporated herein by reference.

REFERENCE TO A SEQUENCE LISTING

A Sequence Listing is provided in this patent document as a .txt file entitled, "50694012003_ST25_Seq_Listing.txt," created Dec. 23, 2011 (file size 555 kB). The content of this file is hereby incorporated by reference.

BACKGROUND OF THE INVENTION

Natriuretic peptides modulate salt and water homeostasis in the body and in this way act as regulators of blood pressure. The peptides belonging to this family have varying amino acid sequences and are secreted through different mechanisms by various tissues in the body. These peptides include atrial natriuretic peptide (ANP), brain natriuretic peptide (BNP), and C-type natriuretic peptide (CNP). These peptides bind to three types of receptors that signal intracellularly to modulate physiological functions. ANP and BNP bind preferentially to natriuretic peptide receptor A (NPR-A) (also known as guanylyl cyclase A (GC-A)), and CNP binds preferentially to natriuretic peptide receptor (NPR-B) (also known as guanylyl cyclase B (GC-B)). All three peptides have similar affinity for natriuretic peptide receptor C(NPR-C), which has both signaling and peptide clearance functions. Clearance of natriuretic peptides also occurs through the action of membrane-bound neutral endopeptidase (NEP).

Peptide binding to NPR-A or NPR-B activates the intracellular guanylyl cyclase domain of these receptors, which produces the second messenger cGMP. cGMP activates or inhibits multiple signaling pathways inside the cell.

Bone formation and longitudinal bone growth in long bones, ribs, and vertebrae occurs via endochondral ossification in the cartilaginous growth plate, which is located at both ends of the bone. One important regulator of bone growth is CNP, which circulates in blood at a very low level, suggesting that it has very little systemic activity on bone. Studies using primary cultures of osteoblast-like cells and chondrocytes have revealed that CNP acts rather as a paracrine/autocrine factor to regulate proliferation and differentiation of osteoblasts and chondrocytes. CNP, through activation of NPR-B guanylyl cyclase, stimulates the production of intracellular messenger cGMP in chondrocytes and is important for bone growth and development.

In humans, CNP is initially produced from the natriuretic peptide precursor C(NPPC) gene as a single chain 126-amino acid pre-pro polypeptide. Removal of the signal peptide yields pro-CNP, and further cleavage by the endoprotease furin generates an active 53-amino acid peptide (CNP53), which is secreted and cleaved again by an unknown enzyme to produce the mature 22-amino acid peptide (CNP22). Both CNP53 and CNP22 bind similarly to NPR-B, and they both induce cGMP production in a dose-dependent and similar fashion.

Genetic deletion of CNP, its cognate receptor, or downstream intracellular effector (PKG) results in severe skeletal dysplasias caused by reduced chondrocyte proliferation and differentiation. In mice lacking CNP, dwarfism and early death occur. At birth, these mice have approximately 10% reduction in bone length, but the growth retardation becomes more severe postnatally, and 70% of the mice die in the first 100 days after birth. Cartilage-specific overexpression of CNP partially rescues the achondroplasia dwarfism of the CNP-deficient mice, suggesting that CNP stimulates bone growth through direct effects on chondrocytes. Functional inactivation of the natriuretic peptide (NPR)-B receptor that binds CNP or gene encoding for cGMP protein kinase II through which cGMP effects are mediated also produces dwarfism.

Skeletal dysplasias are a group of genetic disorders characterized by impaired skeletal growth. The many different forms of skeletal dysplasia, e.g., short limb dwarfism, are associated with significant morbidity and mortality. Achondroplasia is the most common form of short limb dwarfism in human beings, affecting more than 250,000 individuals worldwide. Achondroplasia is caused by mutations in the gene encoding fibroblast growth factor receptor 3 (FGFR3), which cause gain of FGFR3 function. These mutations affect many tissues, but most strikingly the cartilaginous growth plate in the growing skeleton, leading to a variety of manifestations and complications. The severity of the clinical phenotype is related to the capacity of the mutation to overactivate FGFR3 signaling pathways in chondrocytes.

The intracellular production of cGMP resulting from NPR-B activation is known to inhibit the MAP-kinase pathway overactivated by the FGFR3 mutation. Thus, use of CNP or a CNP analog that could activate the NPR-B signaling pathway for the treatment of skeletal dysplasia has been considered. However, a major drawback of the therapeutic use of CNP is its extremely short half-life. Furthermore, experiments in the literature, e.g., Farnum et al. (*Anat. Rec. A Discov. Mol. Cell Evol. Biol.* 288(1):91-103, 2006), have shown that the ability of a molecule to enter the growth plate decreases significantly with molecular weight, with poor or no detectable entry by molecules of 40 kDa or larger into the growth plate. Accordingly, it has been believed that CNP-based therapeutics for skeletal dysplasias such as achondroplasia need to have a relatively small molecular weight in order to be capable of entering the growth plate at a sufficient rate to have a therapeutic effect.

There is thus a need in the art to develop therapeutic molecules having an appreciable half-life and other favorable pharmacokinetic and therapeutic properties for the treatment of a variety of disorders, such as achondroplasia.

SUMMARY OF THE INVENTION

It has surprisingly been discovered that natriuretic peptide-containing polypeptides of the present invention, e.g., including an Fc domain, are therapeutically effective in the treatment of disorders such as achondroplasia.

Accordingly, in a first aspect, the invention features a method of treating a disorder associated with overactivation of FGFR3, a bone or cartilage disorder, or a vascular smooth muscle disorder in a subject, e.g., a human, the method including administering to the subject a therapeutically effective amount of a pharmaceutical composition including: (a) a polypeptide including the structure X-Fc-Y-NP-Z or the structure X-NP-Y-Fc-Z; and (b) a pharmaceutically acceptable excipient, wherein NP is a natriuretic peptide that is an agonist of natriuretic peptide receptor B (NPR-B); and each of X, Y, and Z is, independently, absent or is an amino acid sequence of at least one amino acid. In some embodiments, the disorder associated with overactivation of FGFR3, bone or cartilage disorder, or vascular smooth muscle disorder in the subject is thereby treated.

In a second aspect, the invention features a method of elongating bone in a subject, e.g., a human, the method including administering to the subject a therapeutically effective amount of a pharmaceutical composition including: (a) a polypeptide including the structure X-Fc-Y-NP-Z or the structure X-NP-Y-Fc-Z; and (b) a pharmaceutically acceptable excipient, wherein NP is a natriuretic peptide that is an agonist of natriuretic peptide receptor B (NPR-B); and each of X, Y, and Z is, independently, absent or is an amino acid sequence of at least one amino acid.

In some embodiments of the above aspects, the polypeptide includes the structure X-Fc-Y-NP-Z. In some embodiments, the NP includes the structure: [N-terminal extension]-[short segment]-[ring domain]-[C-terminal extension], wherein the ring domain includes the amino acid sequence of SEQ ID NO: 6, amino acids 11-27 of SEQ ID NO: 30, or SEQ ID NO: 95, and each of the N-terminal extension, short segment, and C-terminal extension is, independently, absent or is an amino acid sequence of at least one amino acid. In some embodiments, the ring domain includes amino acids 6-22 of SEQ ID NO: 126. In some embodiments, the amino acid at position 17 of SEQ ID NO: 126 is Phe, Leu, Ile, Thr, Val, Ala, or Ser. In some embodiments, the amino acid at position 17 of SEQ ID NO: 126 is Phe, Leu, Ile, Thr, Glu, Arg, Tyr, Cys, Pro, Asp, Gly, Ala, Ser, Val, Trp, Asn, Gln, His, or Lys, e.g., Phe, Leu, Ile, Thr, Glu, Arg, Tyr, Cys, Pro, or Asp, e.g., Phe or Leu, e.g., Phe, e.g., Leu. In some embodiments, the ring domain includes the amino acid sequence of SEQ ID NO: 12. In some embodiments, the short segment and the ring domain together include the amino acid sequence of any one of SEQ ID NOs: 4 or 13-30. In some embodiments, the amino acid sequence of the short segment consists of amino acids 1-5 of SEQ ID NO: 4. In some embodiments, the amino acid sequence of the short segment consists of amino acids 1-5, 2-5, 3-5, 4-5, or 5 of SEQ ID NO: 4, amino acids 1-10 of SEQ ID NO: 17, amino acids 1-5 of SEQ ID NO: 19, amino acids 1-3 of SEQ ID NO: 20, amino acids 1-5 of SEQ ID NO: 21, or amino acids 1-6 of SEQ ID NO: 29. In some embodiments, the amino acid sequence of the short segment and the ring domain together consists of the amino acid sequence of SEQ ID NO: 4. In some embodiments, the amino acid sequence of the short segment and the ring domain together consists of the amino acid sequence of any one of SEQ ID NOs: 119-122, 126, or 156-161 (e.g., where X in SEQ ID NO: 126 is Phe, Leu, Ile, Thr, Glu, Arg, Tyr, Cys, Pro, Asp, Gly, Ala, Ser, Val, Trp, Asn, Gln, His, or Lys, e.g., Phe, Leu, Ile, Thr, Glu, Arg, Tyr, Cys, Pro, or Asp, e.g., Phe or Leu, e.g., Phe, e.g., Leu). In some embodiments, the amino acid sequence of the N-terminal extension includes amino acids 1-31 of SEQ ID NO: 11. In some embodiments, the amino acid sequence of the N-terminal extension includes amino acids 17-31 of SEQ ID NO: 11. In some embodiments, the amino acid sequence of the N-terminal extension includes KGANKK (SEQ ID NO: 314) or KGANQK (SEQ ID NO: 315). In some embodiments, the N-terminal extension, short segment, and ring domain together include the amino acid sequence of SEQ ID NO: 11. In some embodiments, the C-terminal extension includes the amino acid sequence of SEQ ID NO: 118, SEQ ID NO: 117, or amino acids 23-37 selected from any one of SEQ ID NOs: 101-116. In some embodiments, the amino acid sequence of the NP consists of SEQ ID NO: 4. In some embodiments, the amino acid sequence of the NP consists of SEQ ID NO: 11. In some embodiments, the amino acid sequence of the NP consists of the amino acid sequence of any one of SEQ ID NOs: 31-94, or a fragment thereof including at least a ring domain.

In any of the aspects described herein, the amino acid sequence of the NP includes amino acids 6-22 of SEQ ID NO: 126, and the amino acid at position 17 of SEQ ID NO: 126 is Phe.

In any of the aspects described herein, the amino acid sequence of the NP includes amino acids 6-22 of SEQ ID NO: 126, and the amino acid at position 17 of SEQ ID NO: 126 is Leu.

In of the aspects described herein, the amino acid sequence of the NP includes amino acids 6-22 of SEQ ID NO: 126, and the amino acid at position 17 of SEQ ID NO: 126 is Ile.

In any of the aspects described herein, the amino acid sequence of the NP includes amino acids 6-22 of SEQ ID NO: 126, and the amino acid at position 17 of SEQ ID NO: 126 is Thr.

In any of the aspects described herein, the amino acid sequence of the NP includes amino acids 6-22 of SEQ ID NO: 126, and the amino acid at position 17 of SEQ ID NO: 126 is Glu.

In any of the aspects described herein, the amino acid sequence of the NP includes amino acids 6-22 of SEQ ID NO: 126, and the amino acid at position 17 of SEQ ID NO: 126 is Arg.

In any of the aspects described herein, the amino acid sequence of the NP includes amino acids 6-22 of SEQ ID NO: 126, and the amino acid at position 17 of SEQ ID NO: 126 is Tyr.

In any of the aspects described herein, the amino acid sequence of the NP includes amino acids 6-22 of SEQ ID NO: 126, and the amino acid at position 17 of SEQ ID NO: 126 is Cys.

In any of the aspects described herein, the amino acid sequence of the NP includes amino acids 6-22 of SEQ ID NO: 126, and the amino acid at position 17 of SEQ ID NO: 126 is Pro.

In any of the aspects described herein, the amino acid sequence of the NP includes amino acids 6-22 of SEQ ID NO: 126, and the amino acid at position 17 of SEQ ID NO: 126 is Asp.

In any of the aspects described herein, the amino acid sequence of the NP includes amino acids 6-22 of SEQ ID NO: 126, and the amino acid at position 17 of SEQ ID NO: 126 is Gly.

In any of the aspects described herein, the amino acid sequence of the NP includes amino acids 6-22 of SEQ ID NO: 126, and the amino acid at position 17 of SEQ ID NO: 126 is Ala.

In any of the aspects described herein, the amino acid sequence of the NP includes amino acids 6-22 of SEQ ID NO: 126, and the amino acid at position 17 of SEQ ID NO: 126 is Ser.

In any of the aspects described herein, the amino acid sequence of the NP includes amino acids 6-22 of SEQ ID NO: 126, and the amino acid at position 17 of SEQ ID NO: 126 is Val.

In any of the aspects described herein, the amino acid sequence of the NP includes amino acids 6-22 of SEQ ID NO: 126, and the amino acid at position 17 of SEQ ID NO: 126 is Trp.

In any of the aspects described herein, the amino acid sequence of the NP includes amino acids 6-22 of SEQ ID NO: 126, and the amino acid at position 17 of SEQ ID NO: 126 is Asn.

In any of the aspects described herein, the amino acid sequence of the NP includes amino acids 6-22 of SEQ ID NO: 126, and the amino acid at position 17 of SEQ ID NO: 126 is Gln.

In any of the aspects described herein, the amino acid sequence of the NP includes amino acids 6-22 of SEQ ID NO: 126, and the amino acid at position 17 of SEQ ID NO: 126 is His.

In any of the aspects described herein, the amino acid sequence of the NP includes amino acids 6-22 of SEQ ID NO: 126, and the amino acid at position 17 of SEQ ID NO: 126 is Lys.

In some embodiments, the amino acid sequence of the NP consists of the amino acid sequence of any one of SEQ ID NOs: 13-29, 100-116, 119-125, 127-233, or 1001-1155.

In some embodiments, the NP is selective for NPR-B over NPR-A, wherein the $EC_{50(NPR-A)}/EC_{50(NPR-B)}$ ratio for the NP, as determined in an in vivo pharmacokinetic assay, is at least 30.

In some embodiments, the Fc includes a $C_{H2}$ domain, a $C_{H3}$ domain, and a hinge region. In some embodiments, the Fc is a constant domain of an immunoglobulin selected from the group consisting of IgG-1, IgG-2, IgG-3, IgG-3 and IgG-4. In some embodiments, the Fc includes the amino acid sequence of SEQ ID NO: 401. In some embodiments, the immunoglobulin is IgG-1. In some embodiments, the amino acid sequence of the Fc includes an amino acid sequence having at least 80%, 85%, 90%, 95%, or 99% sequence identity to SEQ ID NO: 401, or includes or consists of the amino acid sequence of SEQ ID NO: 401.

In some embodiments, Y includes a glycine-rich region, or the amino acid sequence of Y consists of one or more glycines and one or more serines. For example, the amino acid sequence of Y may include $[(Gly)_m(Ser)]_n(Gly)_p$ or $(Gly)_p[(Ser)(Gly)_m]_n$, wherein each of m, n, and p is, independently, between 0 and 20. In some embodiments, m is between 1 and 6; n is between 1 and 10; and p is between 0 and 4. In some embodiments, m is 4 and n is 1-6. In some embodiments, combinations of m, n, and p are selected from a single row of Table 1, or the amino acid sequence of Y includes the amino acid sequence of any one of SEQ ID NOs: 301-389. In some embodiments, the amino acid sequence of Y consists of $[(Gly)_m(Ser)]_n(Gly)_p$ or $(Gly)_p[(Ser)(Gly)_m]_n$, wherein combinations of m, n, and p are selected from a single row of Table 1, or the amino acid sequence of Y consists of the amino acid sequence of any one of SEQ ID NOs: 301-389.

In some embodiments, X is absent, Z is absent, or X and Z are both absent.

In some embodiments, X, Y, or Z includes a bone-targeting moiety, e.g., including 6, 7, 8, 9, 10, 11, 12, 13, 14, 15, or 16 consecutive acidic residues, e.g., aspartic acid or glutamic acid. In some embodiments, the bone-targeting moiety includes or consists of $E_6$, $E_7$, $E_8$, $E_9$, $E_{10}$, $E_{11}$, $E_{12}$, $E_{13}$, $E_{14}$, $E_{15}$, $E_{16}$, $D_6$, $D_7$, $D_8$, $D_9$, $D_{10}$, $D_{11}$, $D_{12}$, $D_{13}$, $D_{14}$, $D_{15}$, or $D_{16}$, e.g., $E_6$, $E_{10}$, $D_6$, or $D_{10}$.

In some embodiments, X, Y, or Z includes a cathepsin (e.g., cathepsin K) cleavage sequence. In some embodiments, the cathepsin cleavage sequence includes or consists of HGPQG (SEQ ID NO: 374) or HKLRG (SEQ ID NO: 375).

In some embodiments, the polypeptide includes or consists of the amino acid sequence of any one of SEQ ID NOs: 501-608, e.g., SEQ ID NO: 502, SEQ ID NO: 504, SEQ ID NO: 506, SEQ ID NO: 512, SEQ ID NO: 514, SEQ ID NO: 516, SEQ ID NO: 560, SEQ ID NO: 562, SEQ ID NO: 564, SEQ ID NO: 572, SEQ ID NO: 574, SEQ ID NO: 576, SEQ ID NO: 584, SEQ ID NO: 586, SEQ ID NO: 588, SEQ ID NO: 596, SEQ ID NO: 598, SEQ ID NO: 600, or SEQ ID NO: 608.

In some embodiments, the polypeptide includes a bone-targeting moiety, e.g., $E_6$, $E_7$, $E_8$, $E_9$, $E_{10}$, $E_{11}$, $E_{12}$, $E_{13}$, $E_{14}$, $E_{15}$, $E_{16}$, $D_6$, $D_7$, $D_8$, $D_9$, $D_{10}$, $D_{11}$, $D_{12}$, $D_{13}$, $D_{14}$, $D_{15}$, or $D_{16}$, e.g., $E_6$, $E_{10}$, $D_6$, or $D_{10}$.

In some embodiments, the polypeptide includes or consists of the amino acid sequence of SEQ ID NO: 512.

In some embodiments, the polypeptide includes or consists of the amino acid sequence of SEQ ID NO: 554.

In some embodiments, the polypeptide includes or consists of the amino acid sequence of SEQ ID NO: 572.

In some embodiments, the polypeptide includes or consists of the amino acid sequence of SEQ ID NO: 578.

In a third aspect, the invention features a method of treating a disorder associated with overactivation of FGFR3, a bone or cartilage disorder, or a vascular smooth muscle disorder in a subject, e.g., a human, the method including administering to the subject a therapeutically effective amount of a pharmaceutical composition including: (a) a polypeptide including the structure V-NP-W; and (b) a pharmaceutically acceptable excipient, wherein NP is a natriuretic peptide that is an agonist of natriuretic peptide receptor B (NPR-B); each of V and W is, independently, absent or is an amino acid sequence of at least one amino acid; and the NP includes the amino acid sequence of any one of SEQ ID NOs: 17-29, 31-40, 42-94, 101-116, 119-122, 128-161, or 163-233, or V or W includes the amino acid sequence of any one of SEQ ID NOs: 304-313, 322-333, or 337-389. In some embodiments, the disorder associated with overactivation of FGFR3, bone or cartilage disorder, or vascular smooth muscle disorder in the subject is thereby treated.

In a fourth aspect, the invention features a method of elongating bone in a subject, e.g., a human, the method including administering to the subject a therapeutically effective amount of a pharmaceutical composition including: (a) a polypeptide including the structure V-NP-W; and (b) a pharmaceutically acceptable excipient, wherein NP is a natriuretic peptide that is an agonist of natriuretic peptide receptor B (NPR-B); each of V and W is, independently, absent or is an amino acid sequence of at least one amino acid; and the NP includes the amino acid sequence of any one of SEQ ID NOs: 17-29, 31-40, 42-94, 101-116, 119-122, 128-161, or 163-233, or V or W includes the amino acid sequence of any one of SEQ ID NOs: 304-313, 322-333, or 337-389.

In some embodiments of the third and fourth aspects, any of the NPs or polypeptides described herein may be used in conjunction with the method (e.g., NPs or polypeptides described in some embodiments of the first and second aspects). In some embodiments, the amino acid sequence of V or W includes $[(Gly)_m(Ser)]_n(Gly)_p$ or $(Gly)_p[(Ser)(Gly)_m]_n$, wherein each of m, n, and p is, independently, between 0 and 20. In some embodiments, in is 4 and n is 1-6. In some embodiments, V is absent, W is absent, or V and W are both absent. In some embodiments, V or W includes a bone-targeting moiety, e.g., $E_6$, $E_7$, $E_8$, $E_9$, $E_{10}$, $E_{11}$, $E_{12}$, $E_{13}$, $E_{14}$, $E_{15}$, $E_{16}$, $D_6$, $D_7$, $D_8$, $D_9$, $D_{10}$, $D_{11}$, $D_{12}$, $D_{13}$, $D_{14}$, $D_{15}$, or $D_{16}$, e.g., $E_6$, $E_{10}$, $D_6$, or $D_{10}$. In some embodiments, V or W includes a cathepsin (e.g., cathepsin K) cleavage sequence, e.g., HGPQG (SEQ ID NO: 374) or HKLRG (SEQ ID NO: 375).

In a fifth aspect, the invention features a method of treating a disorder associated with overactivation of FGFR3, a bone or cartilage disorder, or a vascular smooth muscle disorder in a subject, e.g., a human, the method including administering to the subject a therapeutically effective amount of a pharmaceutical composition including: (a) a polypeptide including the structure V-NP or NP-W; and (b) a pharmaceutically acceptable excipient, wherein NP is a natriuretic peptide that is an agonist of natriuretic peptide receptor B (NPR-B); and each of V and W includes, independently, the amino acid sequence of any one of SEQ ID NOs: 304-313, 322-333, or 337-389. In some embodiments, the disorder associated with overactivation of FGFR3, bone or cartilage disorder, or vascular smooth muscle disorder in the subject is thereby treated.

In a sixth aspect, the invention features a method of elongating bone in a subject, e.g., a human, the method including administering to the subject a therapeutically effective amount of a pharmaceutical composition including: (a) a polypeptide including the structure V-NP or NP-W; and (b) a pharmaceutically acceptable excipient, wherein NP is a natriuretic peptide that is an agonist of natriuretic peptide receptor B (NPR-B); and each of V and W includes, independently, the amino acid sequence of any one of SEQ ID NOs: 304-313, 322-333, or 337-389.

In some embodiments of the fifth and sixth aspects, any of the NPs or polypeptides described herein may be used in conjunction with the method (e.g., NPs or polypeptides described in some embodiments of the first and second aspects). In some embodiments, the polypeptide includes the structure V-NP. In some embodiments, the amino acid sequence of V or W includes $[(Gly)_m(Ser)]_n(Gly)_p$ or $(Gly)_p[(Ser)(Gly)_m]_n$, wherein each of m, n, and p is, independently, between 0 and 20. In some embodiments, m is 4 and n is 1-6. In some embodiments, V or W includes a bone-targeting moiety, e.g., $E_6$, $E_7$, $E_8$, $E_9$, $E_{10}$, $E_{11}$, $E_{12}$, $E_{13}$, $E_{14}$, $E_{15}$, $E_{16}$, $D_6$, $D_7$, $D_8$, $D_9$, $D_{10}$, $D_{11}$, $D_{12}$, $D_{13}$, $D_{14}$, $D_{15}$, or $D_{16}$, e.g., $E_6$, $E_{10}$, $D_6$, or $D_{10}$. In some embodiments, V or W includes a cathepsin (e.g., cathepsin K) cleavage sequence, e.g., HGPQG (SEQ ID NO: 374) or HKLRG (SEQ ID NO: 375).

In some embodiments of any of the methods described herein, V or W consists of the amino acid sequence of any one of SEQ ID NOs: 304-313, 322-333, or 337-389.

In some embodiments of any of the methods described herein, the polypeptide is glycosylated or pegylated. In some embodiments, the pharmaceutical composition includes a dimer of the polypeptide. In some embodiments, the pharmaceutically acceptable excipient includes saline. In some embodiments, the pharmaceutical composition is lyophilized. In some embodiments, the pharmaceutical composition is administered subcutaneously, intravenously, orally, nasally, intramuscularly, sublingually, intrathecally, or intradermally.

In some embodiments, the pharmaceutical composition is administered to the subject in a dosage between about 0.5 mg/kg to about 500 mg/kg once, twice, three times, or four times daily. The dosage may be between, e.g., about 5 mg/kg to about 200 mg/kg, e.g., about 10 mg/kg to about 100 mg/kg, once, twice, three times, or four times daily. In some embodiments, the dosage is about 10 mg/kg or about 100 mg/kg twice daily.

In some embodiments, the pharmaceutical composition is administered to the subject in a dosage between about 0.5 mg/kg to about 500 mg/kg once or twice weekly. The dosage may be between, e.g., about 5 mg/kg to about 200 mg/kg, e.g., about 10 mg/kg to about 100 mg/kg, e.g., about 20 mg/kg to about 40 mg/kg, once or twice weekly. In some embodiments, the dosage is about 10 mg/kg, about 30 mg/kg, or about 100 mg/kg, once or twice weekly.

In some embodiments, the pharmaceutical composition is administered to the subject in a dosage between about 10 µg/kg to about 1,000 µg/kg once or twice weekly. The dosage may be between, e.g., about 20 µg/kg to about 800 µg/kg, e.g., about 30 µg/kg to about 600 µg/kg, e.g., about 50 µg/kg to about 500 µg/kg, e.g., about 100 µg/kg to about 400 µg/kg, e.g., about 200 µg/kg to about 300 µg/kg, once or twice weekly. In some embodiments, the dosage is about 30 µg/kg, about 100 µg/kg, about 300 µg/kg, or about 500 µg/kg, once or twice weekly.

In some embodiments, the pharmaceutical composition is administered to the subject between one and fourteen times per week, or is administered at least once daily for at least one month. In preferred embodiments, the pharmaceutical composition is administered to the subject once weekly for at least one month.

In some embodiments of any of the methods described herein, the disorder associated with overactivation of FGFR3 is a bone or cartilage disorder, e.g., a skeletal dysplasia, such as any described herein. In some embodiments of any of the methods described herein, the bone or cartilage disorder is a skeletal dysplasia, e.g., achondroplasia, homozygous achondroplasia, heterozygous achondroplasia, achondrogenesis, acrodysostosis, acromesomelic dysplasia, atelosteogenesis, camptomelic dysplasia, chondrodysplasia punctata, rhizomelic type of chondrodysplasia punctata, cleidocranial dysostosis, congenital short femur, craniosynostosis (e.g., Muenke syndrome, Crouzon syndrome, Apert syndrome, Jackson-Weiss syndrome, Pfeiffer syndrome, or Crouzonodermoskeletal syndrome), dactyl), brachydactyl), camptodactyl), polydactyl), syndactyl), diastrophic dysplasia, dwarfism, dyssegmental dysplasia, enchondromatosis, fibrochondrogenesis, fibrous dysplasia, hereditary multiple exostoses, hypochondroplasia, hypophosphatasia, hypophosphatemic rickets, Jaffe-Lichtenstein syndrome, Kniest dysplasia, Kniest syndrome, Langer-type mesomelic dysplasia, Marfan syndrome, McCune-Albright syndrome, micromelia, metaphyseal dysplasia, Jansen-type metaphyseal dysplasia, metatrophic dysplasia, Morquio syndrome, Nievergelt-type mesomelic dysplasia, neurofibromatosis (e.g., type 1, e.g., with bone manifestations or without bone manifestations; type 2; or schwannomatosis), osteoarthritis, osteochondrodysplasia, osteogenesis imperfecta, perinatal lethal type of osteogenesis imperfecta, osteopetrosis, osteopoikilosis, peripheral dysostosis, Reinhardt syndrome, Roberts syndrome, Robinow syndrome, short-rib polydactyly syndromes, short stature, spondyloepiphyseal dysplasia congenita, spondyloepimetaphyseal dysplasia, or thanatophoric dysplasia. In some embodiments, the pharmaceutical composition is administered in an amount that is therapeutically effective to treat an achondroplasia phenotype selected from the group consisting of growth retardation, skull deformities, and orthodontic defects. In some embodiments, the pharmaceutical composition is administered in an amount that is therapeutically effective to treat an achondroplasia phenotype selected from the group consisting of cervical cord compression, spinal stenosis, hydrocephalus, hearing loss due to chronic otitis, cardiovascular disease, neurological disease, and obesity. In some embodiments of any of the methods described herein, the disorder associated with overactivation of FGFR3 is cancer, e.g., multiple myeloma, myeloproliferative syndrome, leukemia, plasma cell leukemia, lymphoma, glioblastoma, prostate cancer, bladder cancer, or mammary cancer. In some embodiments of any of the methods described herein, the vascular smooth muscle disorder is hypertension, restenosis, arteriosclerosis, acute decompensated heart failure, congestive heart failure, cardiac edema, nephredema, hepatic edema, acute renal insufficiency, or chronic renal insufficiency.

In a seventh aspect, the invention features an isolated polypeptide including the structure X-Fc-Y-NP-Z or the structure X-NP-Y-Fc-Z, wherein NP is a natriuretic peptide that is an agonist of natriuretic peptide receptor B (NPR-B), and wherein either: (i) NP includes amino acids 6-22 of SEQ ID NO: 126, wherein the amino acid at position 17 is not Met; and each of X, Y, and Z is, independently, absent or is an amino acid sequence of at least one amino acid; or (ii) each of X and Z is, independently, absent or is an amino acid sequence of at least one amino acid; and the amino acid sequence of Y includes [(Gly)$_4$(Ser)]$_n$(Gly)$_p$ or (Gly)$_p$[(Ser)(Gly)$_4$]$_n$, wherein n is between 1 and 10 and p is between 0 and 4 or wherein combinations of m, n, and p are selected from a single row of Table 1, or wherein the amino acid sequence of Y includes the amino acid sequence of any one of SEQ ID NOs: 304-313, 322-333, or 337-389.

In some embodiments of the seventh aspect, the polypeptide includes the structure X-Fc-Y-NP-Z.

In some embodiments of the seventh aspect, (i) NP includes amino acids 6-22 of SEQ ID NO: 126, wherein the amino acid at position 17 is not Met; and each of X, Y, and Z is, independently, absent or is an amino acid sequence of at least one amino acid. In some embodiments, the amino acid at position 17 of SEQ ID NO: 126 is Phe, Leu, Ile, Thr, Val, Ala, or Ser. In some embodiments, the amino acid at position 17 of SEQ ID NO: 126 is Phe, Leu, Ile, Thr, Glu, Arg, Tyr, Cys, Pro, Asp, Gly, Ala, Ser, Val, Trp, Asn, Gln, His, or Lys, e.g., Phe, Leu, Ile, Thr, Glu, Arg, Tyr, Cys, Pro, or Asp, e.g., Phe or Leu, e.g., Phe, e.g., Leu. In some embodiments, the NP includes the structure: [N-terminal extension]-[short segment]-[ring domain]-[C-terminal extension], wherein said ring domain comprises amino acids 6-22 of SEQ ID NO: 126, wherein the amino acid at position 17 is not Met, and each of said N-terminal extension, short segment, and C-terminal extension is, independently, absent or is an amino acid sequence of at least one amino acid. In some embodiments, the amino acid sequence of said NP includes or consists of the amino acid sequence of any one of SEQ ID NOs: 119-125 or 156-220, wherein position 17 relative to SEQ ID NO: 126 is not Met, or the amino acid sequence of any one of SEQ ID NOs: 221-233.

In some embodiments of the seventh aspect, (ii) each of X and Z is, independently, absent or is an amino acid sequence of at least one amino acid; and the amino acid sequence of Y comprises [(Gly)$_4$(Ser)]$_n$(Gly)$_p$ or (Gly)$_p$[(Ser)(Gly)$_4$]$_n$, wherein n is between 1 and 10 and p is between 0 and 4, or wherein the amino acid sequence of Y comprises the amino acid sequence of any one of SEQ ID NOs: 304-313, 322-333, or 337-389. In some embodiments, the NP includes the structure: [N-terminal extension]-[short segment]-[ring domain]-[C-terminal extension], wherein the ring domain includes the amino acid sequence of SEQ ID NO: 6, amino acids 11-27 of SEQ ID NO: 30, or SEQ ID NO: 95, and each of the N-terminal extension, short segment, and C-terminal extension is, independently, absent or is an amino acid sequence of at least one amino acid. In some embodiments, the ring domain includes amino acids 6-22 of SEQ ID NO: 126. In some embodiments, the amino acid at position 17 of SEQ ID NO: 126 is Phe, Leu, Ile, Thr, Val, Ala, or Ser. In some embodiments, the amino acid at position 17 of SEQ ID NO: 126 is Phe, Leu, Ile, Thr, Glu, Arg, Tyr, Cys, Pro, Asp, Gly, Ala, Ser, Val, Trp, Asn, Gln, His, or Lys, e.g., Phe, Leu, Ile, Thr, Glu, Arg, Tyr, Cys, Pro, or Asp, e.g., Phe or Leu, e.g., Phe, e.g., Leu. In some embodiments, the ring domain includes the amino acid sequence of SEQ ID NO: 12. In some embodiments, the short segment and the ring domain together include the amino acid sequence of any one of SEQ ID NOs: 4 or 13-30. In some embodiments, the amino acid sequence of the short segment and the ring domain together consists of the amino acid sequence of SEQ ID NO: 4. In some embodiments, the amino acid sequence of the short segment and the ring domain together consists of the amino acid sequence of any one of SEQ ID NOs: 119-122, 126, or 156-161 (e.g.,
where X in SEQ ID NO: 126 is Phe, Leu, Ile, Thr, Glu, Arg, Tyr, Cys, Pro, Asp, Gly, Ala, Ser, Val, Trp, Asn, Gln, His, or Lys, e.g., Phe, Leu, Ile, Thr, Glu, Arg, Tyr, Cys, Pro, or Asp, e.g., Phe or Leu, e.g., Phe, e.g., Leu). In some embodiments, the N-terminal extension, short segment, and ring domain together include the amino acid sequence of SEQ ID NO: 11. In some embodiments, the amino acid sequence of the NP consists of SEQ ID NO: 4. In some embodiments, the amino acid sequence of the NP consists of SEQ ID NO: 11. In some embodiments, the amino acid sequence of the NP consists of the amino acid sequence of any one of SEQ ID NOs: 31-94, or a fragment thereof including at least a ring domain. In some embodiments of the seventh aspect, the amino acid sequence of the NP includes or consists of the amino acid sequence of any one of SEQ ID NOs: 13-29, 100-116, 119-125, 127-233, or 1001-1155.

In any of the embodiments for the seventh aspect, the amino acid sequence of the short segment consists of amino acids 1-5 of SEQ ID NO: 4. In some embodiments, the amino acid sequence of the short segment consists of amino acids 1-5, 2-5, 3-5, 4-5, or 5 of SEQ ID NO: 4, amino acids 1-10 of SEQ ID NO: 17, amino acids 1-5 of SEQ ID NO: 19, amino acids 1-3 of SEQ ID NO: 20, amino acids 1-5 of SEQ ID NO: 21, or amino acids 1-6 of SEQ ID NO: 29. In some embodiments, the amino acid sequence of the N-terminal extension includes amino acids 1-31 of SEQ ID NO: 11. In some embodiments, the amino acid sequence of the N-terminal extension includes amino acids 17-31 of SEQ ID NO: 11. In some embodiments, the amino acid sequence of the N-terminal extension includes KGANKK (SEQ ID NO: 314) or KGANQK (SEQ ID NO: 315). In some embodiments, the C-terminal extension includes the amino acid sequence of SEQ ID NO: 118, SEQ ID NO: 117, or amino acids 23-37 selected from any one of SEQ ID NOs: 101-116.

In any of the embodiments of the seventh aspect, the NP is selective for NPR-B over NPR-A, wherein the $EC_{50(NPR-A)}/EC_{50(NPR-B)}$ ratio for the NP, as determined in an in vivo pharmacokinetic assay, is at least 30.

In any of the embodiments of the seventh aspect, the Fc includes a $C_{H2}$ domain, a $C_{H3}$ domain, and a hinge region. In some embodiments, the Fc is a constant domain of an immunoglobulin selected from the group consisting of IgG-1, IgG-2, IgG-3, IgG-3 and IgG-4. In some embodiments, the Fc includes the amino acid sequence of SEQ ID NO: 401. In some embodiments, the immunoglobulin is IgG-1. In some embodiments, the amino acid sequence of the Fc includes an amino acid sequence having at least 80%, 85%, 90%, 95%, or 99% sequence identity to SEQ ID NO: 401, or includes or consists of the amino acid sequence of SEQ ID NO: 401.

In any of the embodiments of the seventh aspect, Y includes a glycine-rich region, or the amino acid sequence of Y consists of one or more glycines and one or more serines. For example, the amino acid sequence of Y may include [(Gly)$_m$(Ser)]$_n$(Gly)$_p$ or (Gly)$_p$[(Ser)(Gly)$_m$]$_n$, wherein each of m, n, and p is, independently, between 0 and 20. In some embodiments, m is 0-20 (e.g., m is 3-6, 3-7, 3-8, 3-9, 3-10, 3-11, 3-12, 3-14, 3-15, 3-16, 3-17, 3-18, 3-19, 3-20, 4-6, 4-7, 4-8, 4-9, 4-10, 4-11, 4-12, 4-14, 4-15, 4-16, 4-17, 4-18, 4-19, 4-20, 5-6, 5-7, 5-8, 5-9, 5-10, 5-11, 5-12, 5-14, 5-15, 5-16, 5-17, 5-18, 5-19, 5-20, 6-7, 6-8, 6-9, 6-10, 6-11, 6-12, 6-14, 6-15, 6-16, 6-17, 6-18, 6-19, 6-20, 7-8, 7-9, 7-10, 7-11, 7-12, 7-14, 7-15, 7-16, 7-17, 7-18, 7-19, 7-20, 8-9, 8-10, 8-11, 8-12, 8-14, 8-15, 8-16, 8-17, 8-18, 8-19, 8-20, 9-10, 9-11, 9-12, 9-14, 9-15, 9-16, 9-17, 9-18, 9-19, 9-20, 10-11, 10-12, 10-14, 10-15, 10-16, 10-17, 10-18, 10-19, or 10-20). In some embodiments, m is 4 and n is 1-6. In some embodiments, combinations of m, n, and p are selected from a single row of Table 1, or the amino acid sequence of Y includes the amino acid sequence of any one of SEQ ID NOs: 304-313, 322-333, or 337-389. In some embodiments, the amino acid sequence of Y consists of $[(Gly)_m(Ser)]_n(Gly)_p$ or $(Gly)_p[(Ser)(Gly)_m]_n$, wherein combinations of m, n, and p are selected from a single row of Table 1, or the amino acid sequence of Y consists of the amino acid sequence of any one of SEQ ID NOs: 304-313, 322-333, or 337-389.

In some embodiments of the seventh aspect, X is absent, Z is absent, or X and Z are both absent.

In some embodiments of the seventh aspect, X, Y, or Z includes a bone-targeting moiety, e.g., including 6, 7, 8, 9, 10, 11, 12, 13, 14, 15, or 16 consecutive acidic residues, e.g., aspartic acid or glutamic acid. In some embodiments, the bone-targeting moiety includes or consists of $E_6$, $E_7$, $E_8$, $E_9$, $E_{10}$, $E_{11}$, $E_{12}$, $E_{13}$, $E_{14}$, $E_{15}$, $E_{16}$, $D_6$, $D_7$, $D_8$, $D_9$, $D_{10}$, $D_{11}$, $D_{12}$, $D_{13}$, $D_{14}$, $D_{15}$, or $D_{16}$, e.g., $E_6$, $E_{10}$, $D_6$, or $D_{10}$.

In some embodiments of the seventh aspect, X, Y, or Z includes a cathepsin (e.g., cathepsin K) cleavage sequence. In some embodiments, the cathepsin cleavage sequence includes or consists of HGPQG (SEQ ID NO: 374) or HKLRG (SEQ ID NO: 375).

In some embodiments of the seventh aspect, the polypeptide includes or consists of the amino acid sequence of any one of SEQ ID NOs: 501-608, e.g., SEQ ID NO: 502, SEQ ID NO: 504, SEQ ID NO: 506, SEQ ID NO: 512, SEQ ID NO: 514, SEQ ID NO: 516, SEQ ID NO: 560, SEQ ID NO: 562, SEQ ID NO: 564, SEQ ID NO: 572, SEQ ID NO: 574, SEQ ID NO: 576, SEQ ID NO: 584, SEQ ID NO: 586, SEQ ID NO: 588, SEQ ID NO: 596, SEQ ID NO: 598, SEQ ID NO: 600, or SEQ ID NO: 608. In some embodiments, the polypeptide includes a bone-targeting moiety, e.g., $E_6$, $E_7$, $E_8$, $E_9$, $E_{10}$, $E_{11}$, $E_{12}$, $E_{13}$, $E_{14}$, $E_{15}$, $E_{16}$, $D_6$, $D_7$, $D_8$, $D_9$, $D_{10}$, $D_{11}$, $D_{12}$, $D_{13}$, $D_{14}$, $D_{15}$, or $D_{16}$, e.g., $E_6$, $E_{10}$, $D_6$, or $D_{10}$.

In some embodiments of the seventh aspect, the polypeptide includes or consists of the amino acid sequence of SEQ ID NO: 512.

In some embodiments of the seventh aspect, the polypeptide includes or consists of the amino acid sequence of SEQ ID NO: 554.

In some embodiments of the seventh aspect, the polypeptide includes or consists of the amino acid sequence of SEQ ID NO: 571

In some embodiments of the seventh aspect, the polypeptide includes or consists of the amino acid sequence of SEQ ID NO: 578.

In some embodiments of the seventh aspect, the polypeptide includes or consists of the amino acid sequence of SEQ ID NO: 560.

In some embodiments of the seventh aspect, the polypeptide includes or consists of the amino acid sequence of SEQ ID NO: 566.

In some embodiments of the seventh aspect, the polypeptide includes or consists of the amino acid sequence of SEQ ID NO: 538 (e.g., where X in SEQ ID NO: 538 can be any amino acid, e.g., Phe, Leu, Ile, Thr, Glu, Arg, Tyr, Cys, Pro, Asp, Gly, Ala, Ser, Val, Trp, Asn, Gln, His, or Lys, e.g., Phe, Leu, Ile, Thr, Glu, Arg, Tyr, Cys, Pro, or Asp, e.g., Phe or Leu, e.g., Phe, e.g., Leu).

In an eighth aspect, the invention features an isolated polypeptide, wherein the amino acid sequence of the polypeptide includes or consists of any one of SEQ ID NOs: 501-608, e.g., SEQ ID NO: 502, SEQ ID NO: 504, SEQ ID NO: 506, SEQ ID NO: 512, SEQ ID NO: 514, SEQ ID NO: 516, SEQ ID NO: 560, SEQ ID NO: 562, SEQ ID NO: 564, SEQ ID NO: 572, SEQ ID NO: 574, SEQ ID NO: 576, SEQ ID NO: 584, SEQ ID NO: 586, SEQ ID NO: 588, SEQ ID NO: 596, SEQ ID NO: 598, SEQ ID NO: 600, or SEQ ID NO: 608.

In a ninth aspect, the invention features an isolated polypeptide including the structure V-NP-W, wherein NP is a natriuretic peptide that is an agonist of natriuretic peptide receptor B (NPR-B); and each of V and W is, independently, absent or is an amino acid sequence of at least one amino acid; and the NP includes the amino acid sequence of any one of SEQ ID NOs: 101-116, 119-122, 128-161, or 163-233, or V or W includes the amino acid sequence of any one of SEQ ID NOs: 304-313, 322-333, or 337-389.

In a tenth aspect, the invention features an isolated polypeptide including the structure V-NP or NP-W, wherein NP is a natriuretic peptide that is an agonist of natriuretic peptide receptor B (NPR-B); each of V and W includes, independently, the amino acid sequence of any one of SEQ ID NOs: 304-313, 322-333, or 337-389.

In some embodiments of the ninth and tenth aspects, the polypeptide includes the structure V-NP.

In some embodiments of the ninth and tenth aspects, any of the NPs or polypeptides described herein may be used in conjunction with the method (e.g., NPs or polypeptides described in some embodiments of the first, second, and seventh aspects). In some embodiments, the amino acid sequence of V or W includes $[(Gly)_m(Ser)]_n(Gly)_p$ or $(Gly)_p[(Ser)(Gly)_m]_n$, wherein each of m, n, and p is, independently, between 0 and 20. In some embodiments, m is 4 and n is 1-6. In some embodiments, V is absent, W is absent, or V and W are both absent. In some embodiments, V or W includes a bone-targeting moiety, e.g., $E_6$, $E_7$, $E_8$, $E_9$, $E_{10}$, $E_{11}$, $E_{12}$, $E_{13}$, $E_{14}$, $E_{15}$, $E_{16}$, $D_6$, $D_7$, $D_8$, $D_9$, $D_{10}$, $D_{11}$, $D_{12}$, $D_{13}$, $D_{14}$, $D_{15}$, or $D_{16}$, e.g., $E_6$, $E_{10}$, $D_6$, or $D_{10}$. In some embodiments, V or W includes a cathepsin (e.g., cathepsin K) cleavage sequence, e.g., HGPQG (SEQ ID NO: 374) or HKLRG (SEQ ID NO: 375).

In some embodiments of the seventh, ninth, and tenth aspects, the NP includes any of the NPs or polypeptides described herein, e.g., including the structure: [N-terminal extension]-[short segment]-[ring domain]-[C-terminal extension], wherein the ring domain includes the amino acid sequence of SEQ ID NO: 6, amino acids 11-27 of SEQ ID NO: 30, or SEQ ID NO: 95, and each of the N-terminal extension, short segment, and C-terminal extension is, independently, absent or is an amino acid sequence of at least one amino acid. In some embodiments, the ring domain includes amino acids 6-22 of SEQ ID NO: 126. In other embodiments, the amino acid at position 17 of SEQ ID NO: 126 is Phe, Leu, Ile, Thr, Glu, Arg, Tyr, Cys, Pro, or Asp, e.g., Phe or Leu, e.g., Phe, e.g., Leu. In some embodiments, the amino acid sequence of the short segment and the ring domain together consists of the amino acid sequence of any one of SEQ ID NOs: 119-122, 126, or 156-161. In some embodiments, the amino acid sequence of the N-terminal extension includes amino acids 1-31 of SEQ ID NO: 11. In some embodiments, the amino acid sequence of the N-terminal extension includes amino acids 17-31 of SEQ ID NO: 11. In some embodiments, the amino acid sequence of the N-terminal extension includes KGANKK (SEQ ID NO: 314) or KGANQK (SEQ ID NO: 315). In some embodiments, the N-terminal extension, short segment, and ring domain together include the amino acid sequence of SEQ ID NO: 11. In some embodiments, the C-terminal extension includes the amino acid sequence of SEQ ID NO: 118, SEQ ID NO: 117, or amino acids 23-37 selected from any one of SEQ ID NOs: 101-116. In some embodiments, the amino acid sequence of the NP consists of SEQ ID NO: 4. In some embodiments, the amino acid sequence of the NP consists of SEQ ID NO: 11. In some embodiments, the amino acid sequence of the NP consists of the amino acid sequence of any one of SEQ ID NOs: 31-94, or a fragment thereof including at least a ring domain.

In some embodiments of the seventh, eighth, ninth, and tenth aspects, the polypeptide is glycosylated or pegylated. In some embodiments, a pharmaceutical composition includes a dimer of the polypeptide.

In some embodiments of any of the above aspects, any of the polypeptides described herein may include a bone-targeting moiety, e.g., $E_6$, $E_7$, $E_8$, $E_9$, $E_{10}$, $E_{11}$, $E_{12}$, $E_{13}$, $E_{14}$, $E_{15}$, $E_{16}$, $D_6$, $D_7$, $D_a$, $D_9$, $D_{10}$, $D_{11}$, $D_{12}$, $D_{13}$, $D_{14}$, $D_{15}$, or $D_{16}$, e.g., $E_6$, $E_{10}$, $D_6$, or $D_{10}$.

In some embodiments of any of the above aspects, any of the polypeptides described herein may include a cathepsin (e.g., cathepsin K) cleavage sequence, e.g., HGPQG (SEQ ID NO: 374) or HKLRG (SEQ ID NO: 375).

In some embodiments of any of the above aspects, any of the polypeptides described herein may include a polypeptide having reduced (e.g., by about 20%, about 25%, about 30%, about 35%, about 40%, about 45%, about 50%, about 55%, about 60%, about 65%, about 70%, about 75%, about 80%, about 85%, about 90%, about 95%, about 96%, about 97%, about 98%, about 99%, or about 100%) degradation (e.g., by neutral endopeptidase (NEP), insulin degrading enzyme (IDE), or any other enzyme that cleaves a natriuretic peptide in vivo), as compared to a control (e.g., CNP22, CNP53, or any polypeptide described herein, such as a peptide described in International Application Pub. No. WO2010/135541 or U.S. Application Pub. No. 2010-0331256).

In some embodiments of any of the above aspects, the polypeptides described herein have increased (e.g., by about 20%, about 25%, about 30%, about 35%, about 40%, about 45%, about 50%, about 55%, about 60%, about 65%, about 70%, about 75%, about 80%, about 85%, about 90%, about 95%, about 96%, about 97%, about 98%, about 99%, about 100%, or more) efficacy and/or reduced (e.g., by about 20%, about 25%, about 30%, about 35%, about 40%, about 45%, about 50%, about 55%, about 60%, about 65%, about 70%, about 75%, about 80%, about 85%, about 90%, about 95%, about 96%, about 97%, about 98%, about 99%, or about 100%) dose-dependent side effects (e.g., decreased adverse hemodynamic effects, such as decreased lowering of blood pressure), as compared to a control (e.g., any polypeptide described herein, such as a peptide described in International Application Pub. No. WO2010/135541 or U.S. Application Pub. No. 2010-0331256).

In an eleventh aspect, the invention features a pharmaceutical composition including: (a) any of the isolated polypeptides as described herein; and (b) a pharmaceutically acceptable excipient. In some embodiments, the pharmaceutical composition is formulated for treating a disorder associated with overactivation of FGFR3, e.g., a bone or cartilage disorder, e.g., a skeletal dysplasia, e.g., any of the skeletal dysplasias described herein, e.g., achondroplasia or, e.g., craniosynostosis. In some embodiments, the pharmaceutical composition is formulated for treating bone or cartilage disorder, e.g., a skeletal dysplasia, e.g., any of the skeletal dysplasias described herein, e.g., achondroplasia or, e.g., craniosynostosis (e.g., Muenke syndrome, Crouzon syndrome, Apert syndrome, Jackson-Weiss syndrome, Pfeiffer syndrome, or Crouzonodermoskeletal syndrome). In some embodiments, the disorder associated with overactivation of FGFR3 is cancer, e.g., any of the cancers described herein, e.g., multiple myeloma. In some embodiments, the pharmaceutical composition is formulated for treating a vascular smooth muscle disorder, e.g., any of the vascular smooth muscle disorders described herein. In some embodiments, the pharmaceutical composition is formulated for elongating bone, e.g., any of the conditions or disorders described herein that would benefit from bone elongation.

In a twelfth aspect, the invention features a method of treating a disorder associated with overactivation of FGFR3, a bone or cartilage disorder, or a vascular smooth muscle disorder in a subject, the method including administering to the subject a therapeutically effective amount of a pharmaceutical composition including: (a) an isolated nucleic acid molecule encoding any of the polypeptides described herein; and (b) a pharmaceutically acceptable excipient. In some embodiments, the disorder associated with overactivation of FGFR3, bone or cartilage disorder, or vascular smooth muscle disorder in the subject is thereby treated.

In some embodiments of the eleventh and twelfth aspects, the pharmaceutically acceptable excipient includes saline. In some embodiments, the pharmaceutical composition is lyophilized. In some embodiments, the pharmaceutical composition is administered subcutaneously, intravenously, orally, nasally, intramuscularly, sublingually, intrathecally, or intradermally.

In some embodiments, the pharmaceutical composition is administered to the subject in a dosage between about 0.5 mg/kg to about 500 mg/kg once, twice, three times, or four times daily. The dosage may be between, e.g., about 5 mg/kg to about 200 mg/kg, e.g., about 10 mg/kg to about 100 mg/kg, once, twice, three times, or four times daily. In some embodiments, the dosage is about 10 mg/kg or about 100 mg/kg twice daily.

In some embodiments, the pharmaceutical composition is administered to the subject in a dosage between about 0.5 mg/kg to about 500 mg/kg once or twice weekly. The dosage may be between, e.g., about 5 mg/kg to about 200 mg/kg, e.g., about 10 mg/kg to about 100 mg/kg, e.g., about 20 mg/kg to about 40 mg/kg, once or twice weekly. In some embodiments, the dosage is about 10 mg/kg, about 30 mg/kg, or about 100 mg/kg, once or twice weekly.

In some embodiments, the pharmaceutical composition is administered to the subject in a dosage between about 10 µg/kg to about 1,000 µg/kg once or twice weekly. The dosage may be between, e.g., about 20 µg/kg to about 800 vg/kg, e.g., about 30 µg/kg to about 600 µg/kg, e.g., about 50 µg/kg to about 500 µg/kg, e.g., about 100 µg/kg to about 400 µg/kg, e.g., about 200 µg/kg to about 300 µg/kg, once or twice weekly. In some embodiments, the dosage is about 30 µg/kg, about 100 µg/kg, about 300 µg/kg, or about 500 µg/kg, once or twice weekly. In some embodiments, the pharmaceutical composition is administered to the subject between one and fourteen times per week, or is administered at least once daily for at least one month. In preferred embodiments, the pharmaceutical composition is administered to the subject once weekly for at least one month.

In a thirteenth aspect, the invention features a method of elongating bone in a subject, the method including administering to the subject a therapeutically effective amount of a pharmaceutical composition including: (a) an isolated nucleic acid molecule encoding any of the polypeptides described herein; and (b) a pharmaceutically acceptable excipient.

In some embodiments of the twelfth and thirteenth aspects, the pharmaceutical composition is administered to the subject in a lentiviral vector. In some embodiments, the pharmaceutical composition is administered to the subject at a dosage of from about 0.1 mg to about 10 mg of the isolated nucleic acid.

In a fourteenth aspect, the invention features an isolated nucleic acid molecule encoding any of the polypeptides described herein.

In a fifteenth aspect, the invention features an isolated nucleic acid molecule including the nucleic acid sequence of any one of SEQ ID NOs: 801-806, or including a nucleic acid sequence encoding a polypeptide encoded by any one of SEQ ID NOs: 801-806.

In some embodiments, any of the isolated nucleic acid molecules described herein include a recombinant expression vector, e.g., a lentiviral vector, capable of expressing the polypeptide encoded by the nucleic acid molecule.

In a sixteenth aspect, the invention features an isolated recombinant host cell, e.g., a HEK293 cell, an L cell, a C127 cell, a 3T3 cell, a CHO cell, a BHK cell, or a COS-7 cell, transformed or transfected with any of the isolated nucleic acid molecules described herein.

In a seventeenth aspect, the invention features a pharmaceutical composition including: (a) any of the isolated nucleic acid molecules as described herein; and (b) a pharmaceutically acceptable excipient. In some embodiments, the pharmaceutical composition is formulated for treating a disorder associated with overactivation of FGFR3, e.g., a bone or cartilage disorder, e.g., a skeletal dysplasia, e.g., any of the skeletal dysplasias described herein, e.g., achondroplasia or, e.g., craniosynostosis. In some embodiments, the pharmaceutical composition is formulated for treating a bone or cartilage disorder, e.g., a skeletal dysplasia, e.g., any of the skeletal dysplasias described herein, e.g., achondroplasia or, e.g., craniosynostosis (e.g., Muenke syndrome, Crouzon syndrome, Apert syndrome, Jackson-Weiss syndrome, Pfeiffer syndrome, or Crouzonodermoskeletal syndrome). In some embodiments, the disorder associated with overactivation of FGFR3 is cancer, e.g., any of the cancers described herein, e.g., multiple myeloma. In some embodiments, the pharmaceutical composition is formulated for treating a vascular smooth muscle disorder, e.g., any of the vascular smooth muscle disorders described herein. In some embodiments, the pharmaceutical composition is formulated for elongating bone, e.g., any of the conditions or disorders described herein that would benefit from bone elongation.

In an eighteenth aspect, the invention features a method of producing any of the polypeptides described herein, including culturing any of the host cells described herein in a culture medium under conditions suitable to effect expression of the polypeptide and recovering the polypeptide from the culture medium. In some embodiments, the host cell is a HEK293 cell, an L cell, a C127 cell, a 3T3 cell, a CHO cell, a BHK cell, or a COS-7 cell.

In a nineteenth aspect, the invention features a kit including: (a) any of the pharmaceutical compositions described herein; and (b) instructions for administering the pharmaceutical composition to a subject to treat a disorder associated with overactivation of FGFR3, e.g., any of the disorders associated with overactivation of FGFR3 described herein, e.g., achondroplasia, a bone or cartilage disorder, e.g., any skeletal dysplasia described herein, e.g., craniosynostosis (e.g., Muenke syndrome, Crouzon syndrome, Apert syndrome, Jackson-Weiss syndrome, Pfeiffer syndrome, or Crouzonodermoskeletal syndrome), or a vascular smooth muscle disorder, e.g., any of the vascular smooth muscle disorders described herein.

In a twentieth aspect, the invention features a kit including: (a) any of the pharmaceutical compositions described herein; and (b) instructions for administering the pharmaceutical composition to a subject to elongate bone, e.g., any condition or disorder described herein that would benefit from bone elongation.

In a twenty-first aspect, the invention features a method of treating a disorder associated with overactivation of FGFR3, a bone or cartilage disorder, or a vascular smooth muscle disorder in a subject, e.g., a human, the method including administering to the subject a therapeutically effective amount of a pharmaceutical composition including: (a) a polypeptide of the seventh, eighth, ninth, or tenth aspect, as described herein, and (b) a pharmaceutically acceptable excipient; or a therapeutically effective amount of a pharmaceutical composition of the eleventh aspect, as described herein. In some embodiments, the disorder associated with overactivation of FGFR3, bone or cartilage disorder, or vascular smooth muscle disorder in the subject is thereby treated.

In a twenty-second aspect, the invention features a method of elongating bone in a subject, e.g., a human, the method including administering to the subject a therapeutically effective amount of a pharmaceutical composition including: (a) a polypeptide of the seventh, eighth, ninth, or tenth aspect, as described herein, and (b) a pharmaceutically acceptable excipient; or a therapeutically effective amount of a pharmaceutical composition of the eleventh aspect, as described herein.

In a twenty-third aspect, the invention features a method of treating a disorder associated with overactivation of FGFR3, a bone or cartilage disorder, or a vascular smooth muscle disorder in a subject, e.g., a human, the method including administering to the subject a therapeutically effective amount of a pharmaceutical composition including: (a) an isolated nucleic acid molecule of the fourteenth or fifteenth aspect, as described herein, and (b) a pharmaceutically acceptable excipient; or a therapeutically effective amount of a pharmaceutical composition of the seventeenth aspect, as described herein. In some embodiments, the disorder associated with overactivation of FGFR3, bone or cartilage disorder, or vascular smooth muscle disorder in the subject is thereby treated.

In a twenty-fourth aspect, the invention features a method of elongating bone in a subject, e.g., a human, the method including administering to the subject a therapeutically effective amount of a pharmaceutical composition including: (a) an isolated nucleic acid molecule of the fourteenth or fifteenth aspect, as described herein, and (b) a pharmaceutically acceptable excipient; or a therapeutically effective amount of a pharmaceutical composition of the seventeenth aspect, as described herein.

In some embodiments of the twenty-third and twenty-fourth aspects, the pharmaceutical composition is administered to the subject in a lentiviral vector. In some embodiments, the pharmaceutical composition is administered to the subject at a dosage of from about 0.1 mg to about 10 mg of the isolated nucleic acid.

In any of the embodiments described herein, the polypeptide may or may not be isolated.

As used herein, the term "about" means ±10% of the recited value.

By "area under the curve" or "AUC" in the context of an in vivo pharmacokinetic assay is meant the area under the serum concentration vs. time curve after administration in an animal.

By "bone or cartilage disorder" is meant any disorder, disease, or other abnormality that affects the function, structure, or growth of bone or cartilage.

By "bone-targeting moiety" is meant an amino acid sequence of between 6 and 20 amino acid residues in length having a sufficient affinity to the bone matrix such that the bone-targeting moiety, taken alone, has an in vivo binding affinity to the bone matrix that is at least $10^{-6}$ M or better (e.g., $10^{-7}$M, $10^{-8}$M, $10^{-9}$M, or better).

By "cathepsin cleavage sequence" is meant an amino acid sequence having a site that can be cleaved by cathepsin with a $k_{cat}/K_M$ rate constant of at least $10^3$ $M^{-1}s^{-1}$ (e.g., $10^4$ $M^{-1}s^{-1}$, $10^5$ $M^{-1}s^{-1}$, $10^6$ $M^{-1}s^{-1}$, $10^7$ $M^{-1}s^{-1}$, or $10^8 M^{-1}s^{-1}$) at 30° C. or higher (e.g., 37° C.). In particular embodiments, the cathepsin cleavage sequence is specific for cathepsin K. Exemplary cathepsin cleavage sequences are P2-P1-P1', where cleavage by the enzyme would occur at the P1-P1' peptide bond; P2 is preferentially composed of Pro, Leu, Ile, but could also be Val, Norleucine, Met, or Ala; P1 is preferentially Arg, Lys, Gln, but could also be Met, Norleucine, Leu, Ile, or Thr; and P1' can be any amino acid but is preferentially Gly. Additional cathepsin cleavage sequences are provided in Choe et al., J. Biol. Chem. 281(18):12824-832, 2006, which is incorporated herein by reference.

By "CNP22" is meant human CNP22 (SEQ ID NO: 4), unless a different meaning is expressly indicated.

By "CNP53" is meant human CNP53 (SEQ ID NO: 11), unless a different meaning is expressly indicated.

By "disorder associated with overactivation of FGFR3" is meant any disorder, disease, or other abnormality that is caused by, or is associated with, overactivation of FGFR3, e.g., stemming from a gain-of-function FGFR3 mutation.

By "efficacy" is meant the $E_{max}$ value of a compound in a dose-response assay.

By "Fc" is meant a fragment crystallizable region of an immunoglobulin, e.g., IgG-1, IgG-2, IgG-3, IgG-3 or IgG-4, including the $C_{H2}$ and $C_{H3}$ domains of the immunoglobulin heavy chain. Fc may also include any portion of the hinge region joining the Fab and Fc regions. The Fc can be of any mammal, including human, and may be post-translationally modified (e.g., by glycosylation). In a non-limiting example, Fc can be the fragment crystallizable region of human IgG-1 having the amino acid sequence of SEQ ID NO: 401.

By "fragment" is meant a portion of a polypeptide or nucleic acid molecule that contains, preferably, at least 10%, 20%, 30%, 40%, 50%, 60%, 70%, 75%, 80%, 85%, 90%, 95%, 96%, 97%, 98%, 99%, or more of the entire length of the reference nucleic acid molecule or polypeptide. A fragment may contain, e.g., 10, 15, 20, 25, 30, 35, 40, 45, 50, 55, 60, 65, 70, 75, 80, 85, 90, 95, 100, 110, 120, 130, 140, 150, 160, 170, 180, 190, 200, 210, 220, 230, 240, 250, 260, 270, 280, 290, 300, 310, 320, 330, 340, 350, 360, 370, 380, 390, 400, 500, 600, 700, 800, 900, 1,000, or more nucleotides, up to the entire length of the nucleic acid molecule, or 10, 15, 20, 25, 30, 35, 40, 45, 50, 55, 60, 65, 70, 75, 80, 85, 90, 95, 100, 110, 120, 130, 140, 150, 160, 170, 180, 190, 200, 210, 220, 230, 240, 250, 260, 270, 280, 290, 300, or more amino acids, up to the entire length of the polypeptide. Exemplary NP fragments have at least a consensus ring domain, e.g., of SEQ ID NOs: 6, 30, or 95, and may include additional N-terminal and/or C-terminal portions.

By "homolog" is meant a polypeptide or nucleic acid molecule exhibiting at least 50% identity to a reference amino acid sequence or nucleic acid sequence. Such a sequence is generally at least, e.g., 50%, 60%, 70%, 75%, 80%, 85%, 90%, 95%, 96%, 97%, 98%, or 99% identical at the amino acid level or nucleic acid to a reference sequence. In general, for polypeptides, the length of comparison sequences can be at least five amino acids, e.g., 10, 20, 30, 40, 50, 60, 70, 80, 90, 100, 125, 150, 175, 200, 250, 300, or more amino acids, up to the entire length of the polypeptide. For nucleic acids, the length of comparison sequences can generally be at least 10, 20, 30, 40, 50, 60, 70, 80, 90, 100, 125, 150, 175, 200, 250, 300, 400, 500, 600, 700, 800, 900, 1000, or more nucleotides, up to the entire length of the nucleic acid molecule. It is understood that for the purposes of determining sequence identity when comparing a DNA sequence to an RNA sequence, a thymine nucleotide is equivalent to a uracil nucleotide.

As used herein, when a polypeptide or nucleic acid sequence is referred to as having "at least X % sequence identity" to a reference sequence, it is meant that at least X percent of the amino acids or nucleotides in the polypeptide or nucleic acid are identical to those of the reference sequence when the sequences are optimally aligned. An optimal alignment of sequences can be determined in various ways that are within the skill in the art, for instance, the Smith Waterman alignment algorithm (Smith et al., J. Mol. Biol. 147:195-7, 1981) and BLAST (Basic Local Alignment Search Tool; Altschul et al., J. Mol. Biol. 215: 403-10, 1990). These and other alignment algorithms are accessible using publicly available computer software such as "Best Fit" (Smith and Waterman, Advances in Applied Mathematics, 482-489, 1981) as incorporated into GeneMatcher Plus™ (Schwarz and Dayhof, Atlas of Protein Sequence and Structure, Dayhoff, M. O., Ed pp 353-358, 1979), BLAST, BLAST-2, BLAST-P, BLAST-N, BLAST-X, WU-BLAST-2, ALIGN, ALIGN-2, CLUSTAL, or Megalign (DNASTAR). In addition, those skilled in the art can determine appropriate parameters for measuring alignment, including any algorithms needed to achieve optimal alignment over the length of the sequences being compared.

By "hybridize" is meant to pair to form a double-stranded molecule between complementary polynucleotides, or portions thereof, under various conditions of stringency. (See, e.g., Wahl, G. M. and S. L. Berger (1987) Methods Enzymol. 152:399; Kimmel, A. R. (1987) Methods Enzymol. 152:507.) For example, high stringency salt concentration will ordinarily be less than about 750 mM NaCl and 75 mM trisodium citrate, less than about 500 mM NaCl and 50 mM trisodium citrate, or less than about 250 mM NaCl and 25 mM trisodium citrate. Low stringency hybridization can be obtained in the absence of organic solvent, e.g., formamide, while high stringency hybridization can be obtained in the presence of at least about 35% formamide or at least about 50% formamide. High stringency temperature conditions will ordinarily include temperatures of at least about 30° C., 37° C., or 42° C. Varying additional parameters, such as hybridization time, the concentration of detergent, e.g., sodium dodecyl sulfate (SDS), and the inclusion or exclusion of carrier DNA, are well known to those skilled in the art. Various levels of stringency are accomplished by combining these various conditions as needed. In one embodiment, hybridization will occur at 30° C. in 750 mM NaCl, 75 mM trisodium citrate, and 1% SDS. In an alternative embodiment, hybridization will occur at 37° C. in 500 mM NaCl, 50 mM trisodium citrate, 1% SDS, 35% formamide, and 100 µg/ml denatured salmon sperm DNA (ssDNA). In a further alternative embodiment, hybridization will occur at 42° C. in 250 mM NaCl, 25 mM trisodium citrate, 1% SDS, 50% formamide, and 200 µg/ml ssDNA. Useful variations on these conditions will be readily apparent to those skilled in the art.

For most applications, washing steps that follow hybridization will also vary in stringency. Wash stringency conditions can be defined by salt concentration and by temperature. As above, wash stringency can be increased by decreasing salt concentration or by increasing temperature. For example, high stringency salt concentrations for the wash steps may be, e.g., less than about 30 mM NaCl and 3 mM trisodium citrate, or less than about 15 mM NaCl and 1.5 mM trisodium citrate. High stringency temperature conditions for the wash steps will ordinarily include a temperature of, e.g., at least about 25° C., 42° C., or 68° C. In one embodiment, wash steps will occur at 25° C. in 30 mM NaCl, 3 mM trisodium citrate, and 0.1% SDS. In an alternative embodiment, wash steps will occur at 42° C. in 15 mM NaCl, 1.5 mM trisodium citrate, and 0.1% SDS. In a further alternative embodiment, wash steps will occur at 68° C. in 15 mM NaCl, 1.5 mM trisodium citrate, and 0.1% SDS. Additional variations on these conditions will be readily apparent to those skilled in the art. Hybridization techniques are well known to those skilled in the art and are described, for example, in Benton and Davis (Science 196: 180, 1977); Grunstein and Hogness (Proc. Natl. Acad. Sci., USA 72:3961, 1975); Ausubel et al. (Current Protocols in Molecular Biology, Wiley Interscience, New York, 2001); Berger and Kimmel (Guide to Molecular Cloning Techniques, 1987, Academic Press, New York); and Sambrook et al., Molecular Cloning: A Laboratory Manual, Cold Spring Harbor Laboratory Press, New York.

By "isolated" or "purified" is meant separated from other naturally accompanying components. Typically, a compound (e.g., polypeptide, nucleic acid, or small molecule), factor, cell, or other component is considered isolated when it is at least, e.g., 50%, 60%, 70%, 75%, 80%, 85%, 90%, 95%, 96%, 97%, 98%, or even 99%, by weight, free from proteins, antibodies, naturally-occurring organic molecules, and other components with which it is naturally associated. In some instances, the component is at least 75%, 90%, or even 99%, by weight, pure. An isolated component may be obtained by chemical synthesis, separation of the factor from natural sources, or production of the component in a recombinant host cell that does not naturally produce the component. Proteins and small molecules may be purified by one skilled in the art using standard techniques such as those described by Ausubel et al. (Current Protocols in Molecular Biology, John Wiley & Sons, New York, 2000). The component is preferably at least, e.g., 2, 5, or 10 times as pure as the starting material, as measured using, e.g., polyacrylamide gel electrophoresis, column chromatography, optical density, HPLC analysis, or Western analysis (Ausubel et al., supra). Exemplary methods of purification are column chromatography, immunoprecipitation, and magnetic bead immunoaffinity purification.

By "natriuretic peptide that is an agonist of natriuretic peptide receptor B" (abbreviated "NP") is meant a natriuretic peptide as described herein, e.g., human CNP22 (SEQ ID NO: 4), or variant thereof, that is capable of agonizing NPR-B, e.g., human NPR-B, with at least 0.000001, 0.000005, 0.00001, 0.00005, 0.0001, 0.0005, 0.001, 0.005, 0.01, 0.05, 0.1, 0.5, 0.9, or 1 times the potency, and at least 1%, 2%, 5%, 10%, 20%, 30%, 40%, 50%, 60%, 70%, 80%, 90%, 95%, 95%, or even 100% times the efficacy of CNP22 as measured in a standard NPR-B activation assay, e.g., a membrane assay or whole cell assay, as described herein. Variant NPs may include one or more substitutions, additions or deletions relative to CNP22 and have the ability to agonize NPR-B. An NP as described herein may include any other sequence or moiety, attached covalently or non-covalently, provided that the NP has the ability to agonize NPR-B.

By "nucleic acid molecule" is meant a molecule, e.g., RNA or DNA, having a sequence of two or more covalently bonded, naturally occurring or modified nucleotides. The nucleic acid molecule may be, e.g., single or double stranded, and may include modified or unmodified nucleotides, or mixtures or combinations thereof. Various salts, mixed salts, and free acid forms are also included.

The terms "peptide," "polypeptide," and "protein" are used interchangeably and refer to any chain of two or more natural or unnatural amino acids, regardless of post-translational modification (e.g., glycosylation or phosphorylation), constituting all or part of a naturally-occurring or non-naturally occurring polypeptide or peptide, as is described herein.

As used herein, a natural amino acid is a natural α-amino acid having the L-configuration, such as those normally occurring in natural polypeptides. Unnatural amino acid refers to an amino acid that normally does not occur in polypeptides, e.g., an epimer of a natural α-amino acid having the L configuration, that is to say an amino acid having the unnatural D-configuration; or a (D,L)-isomeric mixture thereof; or a homolog of such an amino acid, for example, a β-amino acid, an α,α-disubstituted amino acid, or an α-amino acid wherein the amino acid side chain has been shortened by one or two methylene groups or lengthened to up to 10 carbon atoms, such as an α-amino alkanoic acid with 5 up to and including 10 carbon atoms in a linear chain, an unsubstituted or substituted aromatic (α-aryl or α-aryl lower alkyl), for example, a substituted phenylalanine or phenylglycine.

By "pharmaceutically acceptable carrier" or "pharmaceutically acceptable excipient" is meant a carrier or excipient that is physiologically acceptable to the treated patient while retaining the therapeutic properties of the compound with which it is administered. One exemplary pharmaceutically acceptable carrier substance is physiological saline. Other physiologically acceptable carriers and their formulations are known to those skilled in the art and described, for example, in Remington's Pharmaceutical Sciences, (20th edition), ed. A. Gennaro, 2000, Lippincott, Williams & Wilkins, Philadelphia, Pa.

By "pharmaceutical composition" is meant a composition containing a polypeptide or nucleic acid molecule as described herein formulated with a pharmaceutically acceptable excipient, and manufactured or sold with the approval of a governmental regulatory agency as part of a therapeutic regimen for the treatment or prevention of a disease or event in a subject. Pharmaceutical compositions can be formulated, for example, for subcutaneous administration, intravenous administration (e.g., as a sterile solution free of particulate emboli and in a solvent system suitable for intravenous use), for oral administration (e.g., a tablet, capsule, caplet, gelcap, or syrup), or any other formulation described herein, e.g., in unit dosage form.

By "skeletal dysplasia" is meant a bone or cartilage disorder characterized by short stature or dwarfism.

By "potency" is meant the reciprocal of the $EC_{50}$ value of a compound in a dose-response assay. When comparing potency between a compound and a control or between an assay and a control assay, decreased potency indicates an increased $EC_{50}$ value, and increased potency indicates a decreased $EC_{50}$ value, as compared to the $EC_{50}$ value for the control or the control assay.

By "reduced degradation" is meant having a lower percentage of degraded peptide after exposure to an enzyme for at least 5, 10, 15, 20, 25, 30, 60, 120, 180, or 240 minutes, or higher, or any range between any two of these values, as compared to a percentage of degraded control, such as CNP22, CNP53, or any polypeptide described herein, such as a peptide described in International Application Pub. No. WO2010/135541 or U.S. Application Pub. No. 2010-0331256. The percentage of degraded peptide can be lower by about 20%, about 25%, about 30%, about 35%, about 40%, about 45%, about 50%, about 55%, about 60%, about 65%, about 70%, about 75%, about 80%, about 85%, about 90%, about 95%, about 96%, about 97%, about 98%, about 99%, or about 100%, where the percentage of degraded peptide can be determined by measuring the percentage of degraded peptide directly or indirectly by measuring the percentage of remaining peptide after exposure to an enzyme (e.g., neutral endopeptidase, insulin degrading enzyme, and any other enzyme that cleaves a natriuretic peptide in vivo) and subtracting this percentage of remaining peptide from 100%. Percentage of degraded peptide or remaining peptide can be measured by any useful method, such as liquid chromatography (e.g., high performance liquid chromatography (HPLC)), mass spectrometry (MS), or combined analytic techniques (e.g., LC-MS).

By "reduced dose-dependent side effect" is meant a decrease in one or more adverse effects as a function of a dosage of a compound, as compared to a control (e.g., any polypeptide described herein, such as a peptide described in International Application Pub. No. WO2010/135541 or U.S. Application Pub. No. 2010-0331256). The decrease in one or more adverse effects can be by about 20%, about 25%, about 30%, about 35%, about 40%, about 45%, about 50%, about 55%, about 60%, about 65%, about 70%, about 75%, about 80%, about 85%, about 90%, about 95%, about 96%, about 97%, about 98%, about 99%, or about 100%, as determined by any useful assay for detecting the adverse effect. Exemplary adverse effects include hemodynamic effects, such as a decrease in blood pressure, such as systolic arterial blood pressure, diastolic arterial blood pressure, or mean arterial blood pressure, that results in adverse hypotensive effects, and assays to detect such hemodynamic effects include a sphygmomanometer or an implanted pressure transducer.

By "selective for NPR-B over NPR-A" is meant having an $EC_{50(NPR-A)}/EC_{50(NPR-B)}$ ratio that is at least 1.25, 1.5, 2, 2.5, 3, 3.5, 4, 4.5, 5, 7.5, 10, 12.5, 15, 20, 25, 30, 35, 40, 45, 50, 55, 60, 65, 70, 75, 80, 85, 90, 95, 100, 110, 120, 125, 130, 140, 150, 160, 170, 180, 190, 200, 225, 250, 275, 300, 350, 400, 450, 500, 550, 600, 650, 700, 750, 800, 850, 900, 950, 1,000, 1,100, 1,200, 1,250, 1,300, 1,400, 1,500, 1,750, 2,000, 2,500, 3,000, 4,000, 5,000, 10,000, or higher, or any range between any two of these values, in an in vivo or in vitro dose-response assay, e.g., measuring cGMP production, as described herein. Alternatively, or in addition, the term "selective for NPR-B over NPR-A" means having an $AUC_{(NPR-B)}/AUC_{(NPR-A)}$ ratio that is at least 1.1, 1.2, 1.25, 1.3, 1.4, 1.5, 1.6, 1.7, 1.75, 1.8, 1.9, 2, 2.25, 2.5, 2.75, 3, 3.5, 4, 4.5, 5, 7.5, 10, 12.5, 15, 20, 25, 30, 35, 40, 45, 50, 55, 60, 65, 70, 75, 80, 85, 90, 95, 100, 110, 120, 125, 130, 140, 150, 160, 170, 180, 190, 200, 225, 250, 275, 300, 350, 400, 450, 500, 550, 600, 650, 700, 750, 800, 850, 900, 950, 1,000, 1,100, 1,200, 1,250, 1,300, 1,400, 1,500, 1,750, 2,000, 2,500, 3,000, 4,000, 5,000, 10,000, or higher, or any range between any two of these values, as described herein.

By "signal peptide" or "signal sequence" is meant an amino acid sequence that directs a polypeptide to the cellular membrane such that the polypeptide is secreted. Alternatively, the signal sequence may direct the polypeptide to an intracellular compartment or organelle, such as the Golgi apparatus. A signal sequence may be identified by homology, or biological activity, to a peptide sequence with the known function of targeting a polypeptide to a particular region of the cell. One of ordinary skill in the art can identify a signal sequence by using readily available software (e.g., Sequence Analysis Software Package of the Genetics Computer Group, University of Wisconsin Biotechnology Center, 1710 University Avenue, Madison, Wis. 53705, BLAST, or PILEUP/PRETTYBOX programs). A signal sequence can be one that is, for example, substantially identical to amino acids 1-25 of SEQ ID NO: 501.

By "subject" is meant a mammal, including, but not limited to, a human or non-human mammal, such as a bovine, equine, canine, ovine, or feline.

By "therapeutically effective amount" is meant an amount of a polypeptide or nucleic acid molecule described herein that is sufficient to substantially treat, prevent, delay, suppress, or arrest any symptom of a disorder associated with overactivation of FGFR3, a bone or cartilage disorder (e.g., achondroplasia), or a vascular smooth muscle disorder, or that is sufficient to substantially elongate bone. A therapeutically effective amount of a composition described herein may depend on the severity of the disorder being treated and the condition, weight, and general state of the subject and can be determined by an ordinarily-skilled artisan with consideration of such factors. A therapeutically effective amount of a composition described herein can be administered to a subject in a single dose or in multiple doses administered over a period of time.

By "treating," "treat," or "treatment" is meant the medical management of a patient with the intent to cure, ameliorate, stabilize, reduce the likelihood of, or prevent a disorder associated with overactivation of FGFR3, a bone or cartilage disorder (e.g., achondroplasia), or a vascular smooth muscle disorder, or management of a healthy subject with the intent to elongate bone, e.g., by administering a pharmaceutical composition. This term includes active treatment, that is, treatment directed specifically toward the improvement or associated with the cure of a disease, pathological condition, disorder, or event, and also includes causal treatment, that is, treatment directed toward removal of the cause of the associated disease, pathological condition, disorder, or event. In addition, this term includes palliative treatment, that is, treatment designed for the relief of symptoms rather than the curing of the disease, pathological condition, disorder, or event; symptomatic treatment, that is, treatment directed toward constitutional symptoms of the associated disease, pathological condition, disorder, or event; preventative treatment, that is, treatment directed to minimizing or partially or completely inhibiting the development of the associated disease, pathological condition, disorder, or event, e.g., in a patient who is not yet ill, but who is susceptible to, or otherwise at risk of, a particular disease, pathological condition, disorder, or event; and supportive treatment, that is, treatment employed to supplement another specific therapy directed toward the improvement of the associated disease, pathological condition, disorder, or event.

By "vascular smooth muscle disorder" is meant any disorder, disease, or other abnormality that affects the function, structure, or growth of vascular smooth muscle.

By "vector" is meant a DNA molecule, usually derived from a plasmid or bacteriophage, into which fragments of DNA may be inserted or cloned. A recombinant vector will contain one or more unique restriction sites, and may be capable of autonomous replication in a defined host or vehicle organism such that the cloned sequence is reproducible. A vector contains a promoter operably linked to a gene or coding region such that, upon transfection into a recipient cell, an RNA is expressed.

Other features and advantages of the invention will be apparent from the detailed description and from the claims.

BRIEF DESCRIPTION OF THE DRAWINGS

In figures showing a multiple sequence alignment, "*" represents identity; ":" represents a conserved substitution; and "." represents a semi-conserved substitution.

FIG. 1 is a multiple sequence alignment of human ANP (SEQ ID NO: 1), human urodilatin (SEQ ID NO: 2), human BNP (SEQ ID NO: 3), human CNP22 (SEQ ID NO: 4), and DNP (SEQ ID NO: 5). The 17-amino acid ring domain for each natriuretic peptide is shown in bold and enclosed in a box. A consensus sequence (SEQ ID NO: 6) is shown below, wherein each X represents any amino acid, or optionally represents any amino acid at the corresponding position in one of SEQ ID NOs: 1-5.

FIG. 2 is an alignment of human CNP53 (SEQ ID NO: 11), human CNP22, and human CNP (ring domain only) (SEQ ID NO: 12).

FIG. 3 is a multiple sequence alignment of various CNP22 homologs. The 17-amino acid ring domain for each NP is shown in bold and enclosed in a box. A consensus sequence (SEQ ID NO: 30) is shown below, wherein each X within the ring domain represents any amino acid, or optionally represents any amino acid at the corresponding position in one of SEQ ID NOs: 4 and 13-29. Each X outside the ring domain represents any amino acid or may be absent, or optionally represents any amino acid at the corresponding position in one of SEQ ID NOs: 4 and 13-29.

FIGS. 4A-4G are a multiple sequence alignment of various CNP homologs, in some cases including the N-terminal pre- and pro-sequences. The 17-amino acid ring domain for each NP is shown in bold and enclosed in a box. A consensus sequence (SEQ ID NO: 95) is shown below, wherein each X represents any amino acid, or optionally represents any amino acid at the corresponding position in one of SEQ ID NOs: 31-94.

FIG. 6 is a listing of the amino acid sequence of an exemplary Fc from human IgG-1 (SEQ ID NO: 401).

FIGS. 7A-7E are schematic diagrams of exemplary Fc-NP or NP-Fc constructs. FIG. 7A depicts an Fc-NP dimer. FIG. 7B depicts an NP-Fc dimer. FIG. 7C depicts an Fc:Fc-NP monomer-dimer hybrid. FIG. 7D depicts an NP-Fc:Fc monomer-dimer hybrid. FIG. 7E depicts an NP-Fc:Fc-NP hybrid dimer.

FIG. 8A is a listing of the amino acid sequence of the immature NC2 Streptag ("NC2st") fusion protein (SEQ ID NO: 501), together with a table providing a summary of protein regions. The N-terminal signal sequence, which is cleaved during translation, is underlined. Various linker sequences are shown in italics. The Fc domain is shown in bold. The CNP domain is shown in gray highlighting. FIG. 8B is a listing of the amino acid sequence of the NC2st fusion protein (SEQ ID NO: 502) without the signal sequence. FIG. 8C is a listing of the nucleic acid sequence (SEQ ID NO: 801) encoding the NC2st fusion protein.

FIGS. 12A-12H summarize the results of an efficacy study in $Fgfr3^{369/+}$ mice. Each figure includes one or two charts showing the results of various measurements following necropsy, together with corresponding tables showing statistical analysis of the data. FIG. 12A shows the results of crown-rump length measurements following necropsy. FIG. 12B shows the results of tibia length measurements following necropsy. FIG. 12C shows the results of femur length measurements following necropsy. FIG. 12D shows the results of neck-anal length measurements following necropsy. FIG. 12E shows the results of cervical vertebrae length measurements following necropsy. FIG. 12F shows the results of thoracic vertebrae length measurements following necropsy. FIG. 12G shows the results of lumbar vertebrae length measurements following necropsy. FIG. 12H shows the results of sternum length measurements following necropsy.

FIG. 15A is a listing of the NC2B amino acid sequence, both with the signal sequence (SEQ ID NO: 503) and without the signal sequence (SEQ ID NO: 504), and the D10-NC2 amino acid sequence having a $D_{10}$ tag, both with the signal sequence (SEQ ID NO: 607) and without the signal sequence (SEQ ID NO: 608).

FIG. 15B is a listing of a nucleic acid sequence (SEQ ID NO: 802) encoding NC2B.

FIG. 16A is a listing of amino acid sequences for NC2B-22, NC2B-28, and NC2B-34, both with the signal sequence (SEQ ID NOs: 505, 507, and 509, respectively) and without the signal sequence (SEQ ID NOs: 506, 508, and 510, respectively). Signal sequences are underlined. The Fc domain is shown in bold. Linker sequences are shown in italics. The CNP domain is shown in gray highlighting. FIG. 16B is a listing of a nucleic acid sequence (SEQ ID NO: 803) encoding NC2B-22. FIG. 16C is a listing of a nucleic acid sequence (SEQ ID NO: 804) encoding NC2B-28. FIG. 16D is a listing of a nucleic acid sequence (SEQ ID NO: 805) encoding NC2B-34.

FIG. 18 is a listing of amino acid sequences for NC2-KGANKK and NC2-KGANQK, both with the signal sequence (SEQ ID NOs: 511 and 513, respectively) and without the signal sequence (SEQ ID NOs: 512 and 514, respectively). Signal sequences are underlined. The Fc domain is shown in bold. Linker sequences are shown in italics. The CNP domain is shown in gray highlighting.

FIG. 19 is a listing of amino acid sequences for NC2-CNP53mut2, both with the signal sequence (SEQ ID NO: 515) and without the signal sequence (SEQ ID NOs: 516). Signal sequence is underlined. The Fc domain is shown in bold. Linker sequences are shown in italics. The CNP domain is shown in gray highlighting.

FIG. 20 is a listing of amino acid sequences for Fc-CNP53-A (also referred to as Fc-CNP53 wt) and Fc-CNP53-AAA (also referred to as Fc-CNP53mut), both with the signal sequence (SEQ ID NOs: 517 and 519, respectively) and without the signal sequence (SEQ ID NOs: 518 and 520, respectively). Signal sequences are underlined. The Fc domain is shown in bold. Linker sequences are shown in italics. The CNP domain is shown in gray highlighting.

FIG. 22 is a multiple sequence alignment of various NPs and homologs, including CDNP. The boxed region is the most conserved region of the DNP tail among NPRA-binding peptides. The sequences of numerous CDNP variants are shown in the bottom half of the figure, and a consensus sequence (SEQ ID NO: 118) for the DNP C-terminal tail is also shown. Each X in the consensus sequence represents any amino acid, or optionally represents any amino acid at the corresponding position in one of SEQ ID NOs: 100-116.

FIG. 26A is a listing of amino acid sequences for CNP-16AAlinker-Fc-His 10 (NC1) (SEQ ID NO: 521), CNP-6AAlinker-Fc-His10 (NC3) (SEQ ID NO: 522), CNP-6AAlinker-Fc (SEQ ID NO: 523), CDNP-Fc (SEQ ID NO: 524), CDNP-A17saa-Fc (SEQ ID NO: 525), and CDNP-A17sra-Fc (SEQ ID NO: 526). The CNP domain is shown in gray highlighting. Linker sequences are shown in italics. The Fc domain is shown in bold. FIG. 26B is a listing of the nucleic acid sequence (SEQ ID NO: 806) of NC1.

FIG. 29 is a listing of various point mutants (SEQ ID NOs: 119-125) each having a mutation at position 17 of CNP22, together with a consensus sequence (SEQ ID NO: 126). X represents any amino acid, or optionally represents any amino acid at the corresponding position in one of SEQ ID NOs: 119-125.

FIG. 31 is a listing of amino acid sequences for several CNP variants. The 17-amino acid ring domain for each variant is shown in bold. The linker region is shown in italics.

FIGS. 32A-32E are a listing of amino acid sequences for additional CNP variants.

FIG. 33A shows the results of crown-rump length measurements in vivo over 36 study days. FIG. 33C shows the results of mean tail length measurements in vivo over 36 study days. FIG. 33H shows the results of average body weight measurements in vivo at day 1 and day 36. FIG. 33T shows radiographs of the feet and metatarsal bones following necropsy. FIG. 33V shows the results of foramen magnum height and width measurements following necropsy. FIG. 33Y shows the results of occipital-front distance measurements in the skull following necropsy.

FIG. 34 is a listing of amino acid sequences for CNP22 (SEQ ID NO: 4), CNP-L17 (SEQ ID NO: 120), CNP-F17 (SEQ ID NO: 119), CNP-T17 (SEQ ID NO: 122), D6-14AAlinker-CNP [C3] (SEQ ID NO: 147), CNP-14AAlinker-D6 [C4] (SEQ ID NO: 148), CNP-Nterm2 [C5] (SEQ ID NO: 150), CDNP-S3A4A5R6 [C13] (SEQ ID NO: 115), CDNP29-S3A4A5R6 [C14] (SEQ ID NO: 151), C1(E6) [BC1] (SEQ ID NO: 129), C2(E6) [BC2] (SEQ ID NO: 130), C3 (E6) [BC3] (SEQ ID NO: 131), C4(E6) [BC4] (SEQ ID NO: 132), C5(E6) [BC5] (SEQ ID NO: 133), C6(E6) [BC6] (SEQ ID NO: 134), C7(E6) [BC7] (SEQ ID NO: 135), C8(E6) [BC8] (SEQ ID NO: 136), C9(E6) [BC9] (SEQ ID NO: 137), C10(E6) [BC10] (SEQ ID NO: 138), C11(E6) [BC11] (SEQ ID NO: 139), PGCNP37(E6) (SEQ ID NO: 128), KA1 (SEQ ID NO:152), KA1(E6) (SEQ ID NO:153), KB1 (SEQ ID NO:154), and KB1(E6) (SEQ ID NO: 155). The 17-amino acid ring domain for each variant is shown in bold. The linker sequences are shown in italics. The cathepsin cleavage sequences are shown in underline.

FIG. 35A is a graph showing the results of NEP degradation assays for CNP22, D6-14AAlinker-CNP [C3], CNP-14AAlinker-D6 [C4], CNP-Nterm2 [C5], CDNP-S3A4A5R6 [C13], CDNP29-S3A4A5R6 [C14], KB1(E6), C2(E6), and C3(E6), where these sequences are shown in FIG. 34.

FIG. 38 is a listing of amino acid sequences for CNP variants having a point mutation at position 17 relative to CNP22 (SEQ ID NOs: 126, 119-122, and 156-172). For SEQ ID NOs: 126 and 162, X can be any amino acid, including but not limited to F, L, I, T, E, R, Y, C, P, or D. The 17-amino acid ring domain for each variant is shown in bold. The linker sequences are shown in italics.

FIGS. 39A-39B are listings of amino acid sequences for additional CNP variants having a point mutation at position 17 relative to CNP22 (SEQ ID NOs: 173-220). X can be any amino acid, including but not limited to F, L, I, T, E, R, Y, C, P, or D. The 17-amino acid ring domain for each variant is shown in bold. The linker sequences are shown in italics. The cathepsin cleavage sequences are shown in underline.

FIG. 40 is a listing of amino acid sequences for CNP variants having a point mutation at position 17 relative to CNP22, where the methionine at position 17 has been substituted with a leucine (SEQ ID NOs: 221-233). The 17-amino acid ring domain for each variant is shown in bold. The linker sequences are shown in italics. The cathepsin cleavage sequences are shown in underline.

FIGS. 41A-41E are listings of amino acid sequences for constructs having a point mutation at position 17 relative to CNP22 (SEQ ID NOs: 527-552). X can be any amino acid, including but not limited to F, L, I, T, E, R, Y, C, P, or D. Signal sequences are underlined. The Fc domain is shown in bold. Linker sequences are shown in italics. The CNP domain is shown in gray highlighting.

FIG. 42A-42J are listings of amino acid sequences for NC2 variants (SEQ ID NOs: 511-516 and 553-606) with or without the signal sequence and either with or without a $D_{10}$ bone-targeting moiety at the N-terminal. Signal sequences are underlined. The Fc domain is shown in bold. Linker sequences are shown in italics. The CNP domain is shown in gray highlighting.

FIGS. 44A-44B provide the results at day 36 of a weekly dosing regimen study for NC2B in wild-type mice. FIG. 44A shows the results of naso-anal length measurements following necropsy. FIG. 44B shows the results of humerus (left graph) and femur (right graph) length measurements following necropsy.

DETAILED DESCRIPTION

The present invention features natriuretic peptides, e.g., fused to an Fc domain of an immunoglobulin, nucleic acid molecules encoding such polypeptides, and their uses to treat disorders associated with overactivation of FGFR3, bone or cartilage disorders (e.g., achondroplasia), vascular smooth muscle disorders, as well as to elongate bone. Additional details of the invention are provided below.

NPs

Any natriuretic peptide or variant thereof that is an agonist of natriuretic peptide receptor B ("NPR-B"), e.g., human NPR-B, may be used in any of the methods and compositions described herein.

Natriuretic peptides as described herein are peptides that are capable of agonizing NPR-B. Natriuretic peptides, including CNP, which primarily agonizes NPR-B, and ANP and BNP, which primarily agonize NPR-A, have important roles in multiple biological processes. Multiple sequence alignments of various NP family members and consensus sequences are shown in FIGS. 1-3 and 4A-4G.

A key downstream effect of CNP22 and CNP53, and variants thereof as described herein, in agonizing NPR-B is endochondral ossification. Thus, the NPs described herein are useful, e.g., for treating a wide array of disorders associated with overactivation of FGFR3 and vascular smooth muscle disorders.

Figure 5:
FIG. 5 is a schematic diagram of the structure of a natriuretic peptide as described herein, which includes an optional N-terminal extension, an optional short segment, a required ring domain, and an optional C-terminal extension.

NPs include the schematic structure shown in FIG. 5, wherein the ring domain is required and each of the N-terminal extension, short segment, and C-terminal extension is optional. The ring domain is 17 amino acids long, with cysteine residues at each terminus of the ring domain (positions 1 and 17) that form a disulfide bond. In some embodiments, the ring domain has an amino acid sequence that falls within one of the consensus sequences shown in FIG. 1, 3, or 4A-4G (SEQ ID NO: 6, amino acids 11-27 of SEQ ID NO: 30, or SEQ ID NO: 95, respectively). Any of the ring domains shown in FIGS. 1-3 and 4A-4G may be used in an NP as described herein.

The short segment is a segment immediately N-terminal to the ring domain that is between 0 and 10 amino acids (e.g., 0, 1, 2, 3, 4, 5, 6, 7, 8, 9, or 10 amino acids) in length. Exemplary short segments are shown immediately N-terminal to the boxed region in FIG. 1 or FIG. 3, e.g., residues 1-5 of SEQ ID NO: 4, or the 1, 2, 3, 4, 5, 6, 7, 8, 9, or 10 amino acids immediately N-terminal to the conserved ring domain in any of the species shown in FIGS. 3 and 4A-4G. In some embodiments, the short segment consists of the 5-amino acid portion immediately N-terminal to the conserved ring domain in any of the species shown in FIG. 1, 3, or 4A-4G. In some embodiments, the short segment confers increased selectivity for NPR-B relative to NPR-A.

The N-terminal extension is a region immediately N-terminal to the short segment (if the short segment is present) or the ring domain (if the short segment is not present) and may be of any length, e.g., 0, 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 55, 60, 65, 70, 75, 80, 85, 90, 95, 100, 125, 150, 175, 200, 250, 300, 350, 400, 450, 500, or even more amino acids. This region is absent in CNP22 but is present in CNP53 (residues 1-31 of SEQ ID NO: 11). Exemplary N-terminal extensions are the 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 110, 120, 130, 140, 150, 160, 170, 180, 190, 200, 225, 250, or more residues immediately N-terminal to the short segment, e.g., of 5 amino acids (if short segment is present), or immediately N-terminal to the ring domain (if short segment is not present), of any of the species shown in FIGS. 4A-4G. In some embodiments, the N-terminal extension provides increased selectivity for NPR-B relative to NPR-A.

The C-terminal extension is a region immediately C-terminal to the ring domain and may be of any length, e.g., 0, 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 55, 60, 65, 70, 75, 80, 85, 90, 95, 100, 125, 150, 175, 200, 250, 300, 350, 400, 450, 500, or even more amino acids. This region is absent in CNP22 and CNP53 but is present in the hybrid peptide CDNP (SEQ ID NO: 100). Exemplary C-terminal extensions are shown immediately C-terminal to the boxed region in FIG. 1, e.g., amino acids 24-28 of SEQ ID NO: 1, amino acids 28-32 of SEQ ID NO: 2, amino acids 27-32 of SEQ ID NO: 3, or amino acids 24-38 of SEQ ID NO: 5. In some embodiments, the C-terminal tail includes, or consists of, the DNP C-terminal tail (SEQ ID NO: 117), or a variant thereof having one or more addition, deletion, or substitution mutations (e.g., SEQ ID NO: 118). For example, a C-terminal tail of an NP may include any of the DNP C-terminal tail mutations shown in FIG. 22. In particular, residues 1, 3, 4, 5, 6, and/or 7 of the DNP C-terminal tail (SEQ ID NO: 117) may be mutated, e.g., as in any of the mutations shown in FIG. 22. In some embodiments, the C-terminal extension confers increased selectivity for NPR-B relative to NPR-A.

An NP may optionally be glycosylated at any appropriate one or more amino acid residues.

In addition, an NP may have at least 50% (e.g., 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more) sequence identity to any of the NPs described herein, or to one or more of the ring domain, the short segment, the C-terminal extension, or the N-terminal extension.

An NP may have 1, 2, 3, 4, 5, 6, 7, 8, 9, 10, or more additions, deletions, or substitutions relative to any of the NPs described herein, or to one or more of the ring domain, the short segment, the C-terminal extension, or the N-terminal extension.

An NP as described herein may include any other sequence or moiety, attached covalently or non-covalently, provided that the NP has the ability to agonize NPR-B.

In some embodiments, an NP as described herein may be no more than 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 70, 80, 90, 100, 110, or 120 amino acids in length. Furthermore, in some embodiments, an NP as described herein may be no more than 1.8, 2.0, 2.2, 2.4, 2.6, 2.8, 3.0, 3.2, 3.4, 3.6, 3.8, 4.0, 4.2, 4.4, 4.6, 4.8, 5.0, 5.2, 5.4, 5.6, 5.8, 6.0, 6.2, 6.4, 6.6, 6.8, 7.0, 7.2, 7.4, 7.6, 7.8, 8.0, 8.2, 8.4, 8.6, 8.8, 9.0, 9.2, 9.4, 9.6, 9.8, or 10.0 kilodaltons (kDa) in molecular weight.

NPs that are suitable for use in the compositions and methods described herein include those described, e.g., in U.S. Pat. Nos. 5,352,770; 5,434,133; 6,020,168; 6,034,231; 6,407,211; 6,743,425; 6,818,619; 7,276,481; 7,384,917; and 7,754,852; U.S. Application Pub. Nos. 2007-0197434; 2008-0181903; 2008-0312142; 2009-0170756; 2010-0055150; and 2010-0297021; International Application Pub. Nos. WO 94/20534; WO 02/047871; WO 2004/047871; WO 2005/098490; WO 2008/154226; and WO 2009/067639; European Application Pub. Nos. EP 0497368 and EP 0466174; Furuya et al., Biochem. Biophys. Res. Comm. 183: 964-969 (1992); Takano et al., Zool. Sci., 11: 451-454 (1994); Plater et al., Toxicon., 36(6): 847-857 (1998); and Inoue et al., Proc. Nat. Acad. Sci., 100(17): 10079-10084 (2003), each of which is hereby incorporated by reference in its entirety, including all formulas, structures, and sequences for natriuretic peptides and variants thereof. In alternative embodiments, the NPs referenced in the present paragraph are excluded from the compositions and methods described herein.

In some embodiments, any of the NPs described or incorporated by reference herein may be used in the compositions and methods described herein without fusion to an Fc domain or to a linker, or alternatively may be fused to any of the linkers described herein but not to an Fc domain. Such NPs may be used to treat a disorder associated with overactivation of FGFR3, e.g., achondroplasia, or a vascular smooth muscle disorder, as described herein.

In other embodiments, any of the NPs described or incorporated by reference herein may include a point mutation at position 17 relative to CNP22. Wild-type CNP22 has a methionine at position 17 relative to CNP22, which can be oxidized in vivo and/or which can provide a peptide that is degradable by a protease. As described herein, point mutations at position 17 relative to CNP22 could provide polypeptides having decreased degradation, while maintaining potency. Exemplary amino acids at position 17 relative to CNP22 are Phe, Leu, Ile, Thr, Glu, Arg, Tyr, Cys, Pro, Asp, Gly, Ala, Ser, Val, Trp, Asn, Gln, His, or Lys, e.g., Phe, Leu, Ile, Thr, Glu, Arg, Tyr, Cys, Pro, or Asp, e.g., Phe or Leu, e.g., Leu. For example, the amino acid at position 17 relative to CNP22 could be Phe, Leu, Ile, Thr, Glu, Arg, Tyr, Cys, Pro, and Asp, e.g., Phe or Leu, e.g., Leu. In another example, the amino acid at position 17 relative to CNP22 could be Phe, Leu, Ile, Thr, Val, Ala, or Ser. Alternatively, exemplary amino acids at position 17 relative to CNP22 are Gly, Ala, Ser, Val, Trp, Asn, Gln, His, or Lys.

Furthermore, included in the compositions and methods described herein are nucleic acid molecules encoding any of the NPs and fusion polypeptides described herein, as well as nucleic acid molecules that hybridize under high stringency conditions to at least a portion, e.g., to 20%, 30%, 40%, 50%, 60%, 70%, 75%, 80%, 85%, 90%, 95%, 96%, 97%, 98%, 99%, or even 100%, of a nucleic acid molecule that encodes any of the NPs or fusion polypeptides described herein.

Fragment Crystallizable Region (Fc) Fragments

The fusion polypeptides of the invention may include an N-terminal or C-terminal domain such as Fc, a fragment crystallizable region of an immunoglobulin. An immunoglobulin molecule has a structure that is well known in the art. It includes two light chains (~23 kD each) and two heavy chains (~50-70 kD each) joined by inter-chain disulfide bonds. Immunoglobulins are readily cleaved proteolytically (e.g., by papain cleavage) into Fab (containing the light chain and the VH and CH1 domains of the heavy chain) and Fc (containing the $C_{H2}$ and $C_{H3}$ domains of the heavy chain, along with adjoining sequences). Cleavage typically occurs in a flexible hinge region joining the Fab and Fc regions. For example, papain cleaves the hinge region immediately before the disulfide bonds joining the two heavy chains.

Useful Fc fragments as described herein include the Fc fragment of any immunoglobulin molecule, including IgG, IgM, IgA, IgD, or IgE, and their various subclasses (e.g., IgG-1, IgG-2, IgG-3, IgG-4, IgA-1, IgA-2), taken from any mammal (e.g., human). The Fc fragments of the invention may include, for example, the $C_{H2}$ and $C_{H3}$ domains of the heavy chain, as well as any portion of the hinge region. Furthermore, the Fc region may optionally be glycosylated at any appropriate one or more amino acid residues, e.g., various amino acid residues known to those skilled in the art. In some embodiments, the Fc fragment is of human IgG-1. In particular embodiments, the Fc fragment of the fusion polypeptide has the amino acid sequence of SEQ ID NO: 401, or has at least 50% (e.g., 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more) sequence identity to SEQ ID NO: 401 (FIG. 6).

In some embodiments, engineered, e.g., non-naturally occurring, Fc regions may be utilized in the compositions and methods of the invention, e.g., as described in International Application Pub. No. WO2005/007809, which is hereby incorporated by reference.

An Fc fragment as described herein may have 1, 2, 3, 4, 5, 6, 7, 8, 9, 10, 11, 12, 13, 14, 15, 16, 17, 18, 19, 20, 25, 30, 35, 40, 50, or more additions, deletions, or substitutions relative to any of the Fc fragments described herein.

Linkers

The fusion proteins described herein may include a peptide linker region between the Fc fragment and the NP. The linker region may be of any sequence and length that allows the NP to remain biologically active, e.g., not sterically hindered. Exemplary linker lengths are between 1 and 200 amino acids, e.g., 1-5, 6-10, 11-15, 16-20, 21-25, 26-30, 31-35, 36-40, 41-45, 46-50, 51-55, 56-60, 61-65, 66-70, 71-75, 76-80, 81-85, 86-90, 91-95, 96-100, 101-110, 111-120, 121-130, 131-140, 141-150, 151-160, 161-170, 171-180, 181-190, or 191-200 amino acids. Additional exemplary linker lengths are 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 110, 120, 130, 140, 150, 160, 170, 180, 190, or 200 amino acids. Additional exemplary linker lengths are 14-18, 20-24, 26-30, 32-36, 38-42, and 44-48 amino acids.

In some embodiments, linkers include or consist of flexible portions, e.g., regions without significant fixed secondary or tertiary structure. Exemplary flexible linkers are glycine-rich linkers, e.g., containing at least 50%, 60%, 65%, 70%, 75%, 80%, 85%, 90%, 95%, or even 100% glycine residues. Linkers may also contain, e.g., serine residues. In some cases, the amino acid sequence of linkers consists only of glycine and serine residues.

In some cases, the amino acid sequence of the linker sequence includes or consists of a sequence according to the formula $[(Gly)_m(Ser)]_n(Gly)_p$, where each of m, n, and p is, independently, 0, 1, 2, 3, 4, 5, 6, 7, 8, 9, 10, 11, 12, 13, 14, 15, 16, 17, 18, 19, or 20. In some embodiments, m=1, 2, 3, 4, 5, or 6; n=1, 2, 3, 4, 5, 6, 7, 8, 9, or 10; and p=0, 1, 2, 3, or 4. Alternatively, the linker sequence includes or consists of a sequence according to the formula $(Gly)_p[(Ser)(Gly)_m]_n$, where each of m, n, and p is, independently, 0, 1, 2, 3, 4, 5, 6, 7, 8, 9, 10, 11, 12, 13, 14, 15, 16, 17, 18, 19, or 20. In some embodiments, m=1, 2, 3, 4, 5, or 6; n=1, 2, 3, 4, 5, 6, 7, 8, 9, or 10; and p=0, 1, 2, 3, or 4.

Exemplary combinations of m, n, and p values for either of the preceding two formulae are listed in Table 1.

TABLE 1

| m | n | p |
|---|---|---|
| N/A | 0 | 1 |
| N/A | 0 | 2 |
| N/A | 0 | 3 |
| N/A | 0 | 4 |
| N/A | 0 | 5 |
| N/A | 0 | 6 |
| N/A | 0 | 7 |
| N/A | 0 | 8 |
| N/A | 0 | 9 |
| N/A | 0 | 10 |
| 1 | 1 | 0 |
| 1 | 2 | 0 |
| 1 | 3 | 0 |
| 1 | 4 | 0 |
| 1 | 5 | 0 |
| 1 | 6 | 0 |
| 1 | 7 | 0 |
| 1 | 8 | 0 |
| 1 | 9 | 0 |
| 1 | 10 | 0 |
| 2 | 1 | 0 |
| 2 | 2 | 0 |
| 2 | 3 | 0 |
| 2 | 4 | 0 |
| 2 | 5 | 0 |
| 2 | 6 | 0 |
| 2 | 7 | 0 |
| 2 | 8 | 0 |
| 2 | 9 | 0 |
| 2 | 10 | 0 |
| 3 | 1 | 0 |
| 3 | 2 | 0 |
| 3 | 3 | 0 |
| 3 | 4 | 0 |
| 3 | 5 | 0 |
| 3 | 6 | 0 |
| 3 | 7 | 0 |
| 3 | 8 | 0 |
| 3 | 9 | 0 |
| 3 | 10 | 0 |
| 4 | 1 | 0 |
| 4 | 2 | 0 |
| 4 | 3 | 0 |
| 4 | 4 | 0 |
| 4 | 5 | 0 |
| 4 | 6 | 0 |
| 4 | 7 | 0 |
| 4 | 8 | 0 |
| 4 | 9 | 0 |

TABLE 1-continued

| m | n | p |
|---|---|---|
| 4 | 10 | 0 |
| 5 | 1 | 0 |
| 5 | 2 | 0 |
| 5 | 3 | 0 |
| 5 | 4 | 0 |
| 5 | 5 | 0 |
| 5 | 6 | 0 |
| 5 | 7 | 0 |
| 5 | 8 | 0 |
| 5 | 9 | 0 |
| 5 | 10 | 0 |
| 6 | 1 | 0 |
| 6 | 2 | 0 |
| 6 | 3 | 0 |
| 6 | 4 | 0 |
| 6 | 5 | 0 |
| 6 | 6 | 0 |
| 6 | 7 | 0 |
| 6 | 8 | 0 |
| 6 | 9 | 0 |
| 6 | 10 | 0 |
| 1 | 1 | 1 |
| 1 | 2 | 1 |
| 1 | 3 | 1 |
| 1 | 4 | 1 |
| 1 | 5 | 1 |
| 1 | 6 | 1 |
| 1 | 7 | 1 |
| 1 | 8 | 1 |
| 1 | 9 | 1 |
| 1 | 10 | 1 |
| 2 | 1 | 1 |
| 2 | 2 | 1 |
| 2 | 3 | 1 |
| 2 | 4 | 1 |
| 2 | 5 | 1 |
| 2 | 6 | 1 |
| 2 | 7 | 1 |
| 2 | 8 | 1 |
| 2 | 9 | 1 |
| 2 | 10 | 1 |
| 3 | 1 | 1 |
| 3 | 2 | 1 |
| 3 | 3 | 1 |
| 3 | 4 | 1 |
| 3 | 5 | 1 |
| 3 | 6 | 1 |
| 3 | 7 | 1 |
| 3 | 8 | 1 |
| 3 | 9 | 1 |
| 3 | 10 | 1 |
| 4 | 1 | 1 |
| 4 | 2 | 1 |
| 4 | 3 | 1 |
| 4 | 4 | 1 |
| 4 | 5 | 1 |
| 4 | 6 | 1 |
| 4 | 7 | 1 |
| 4 | 8 | 1 |
| 4 | 9 | 1 |
| 4 | 10 | 1 |
| 5 | 1 | 1 |
| 5 | 2 | 1 |
| 5 | 3 | 1 |
| 5 | 4 | 1 |
| 5 | 5 | 1 |
| 5 | 6 | 1 |
| 5 | 7 | 1 |
| 5 | 8 | 1 |
| 5 | 9 | 1 |
| 5 | 10 | 1 |
| 6 | 1 | 1 |
| 6 | 2 | 1 |
| 6 | 3 | 1 |
| 6 | 4 | 1 |
| 6 | 5 | 1 |
| 6 | 6 | 1 |
| 6 | 7 | 1 |

TABLE 1-continued

| m | n | p |
|---|---|---|
| 6 | 8 | 1 |
| 6 | 9 | 1 |
| 6 | 10 | 1 |
| 1 | 1 | 2 |
| 1 | 2 | 2 |
| 1 | 3 | 2 |
| 1 | 4 | 2 |
| 1 | 5 | 2 |
| 1 | 6 | 2 |
| 1 | 7 | 2 |
| 1 | 8 | 2 |
| 1 | 9 | 2 |
| 1 | 10 | 2 |
| 2 | 1 | 2 |
| 2 | 2 | 2 |
| 2 | 3 | 2 |
| 2 | 4 | 2 |
| 2 | 5 | 2 |
| 2 | 6 | 2 |
| 2 | 7 | 2 |
| 2 | 8 | 2 |
| 2 | 9 | 2 |
| 2 | 10 | 2 |
| 3 | 1 | 2 |
| 3 | 2 | 2 |
| 3 | 3 | 2 |
| 3 | 4 | 2 |
| 3 | 5 | 2 |
| 3 | 6 | 2 |
| 3 | 7 | 2 |
| 3 | 8 | 2 |
| 3 | 9 | 2 |
| 3 | 10 | 2 |
| 4 | 1 | 2 |
| 4 | 2 | 2 |
| 4 | 3 | 2 |
| 4 | 4 | 2 |
| 4 | 5 | 2 |
| 4 | 6 | 2 |
| 4 | 7 | 2 |
| 4 | 8 | 2 |
| 4 | 9 | 2 |
| 4 | 10 | 2 |
| 5 | 1 | 2 |
| 5 | 2 | 2 |
| 5 | 3 | 2 |
| 5 | 4 | 2 |
| 5 | 5 | 2 |
| 5 | 6 | 2 |
| 5 | 7 | 2 |
| 5 | 8 | 2 |
| 5 | 9 | 2 |
| 5 | 10 | 2 |
| 6 | 1 | 2 |
| 6 | 2 | 2 |
| 6 | 3 | 2 |
| 6 | 4 | 2 |
| 6 | 5 | 2 |
| 6 | 6 | 2 |
| 6 | 7 | 2 |
| 6 | 8 | 2 |
| 6 | 9 | 2 |
| 6 | 10 | 2 |
| 1 | 1 | 3 |
| 1 | 2 | 3 |
| 1 | 3 | 3 |
| 1 | 4 | 3 |
| 1 | 5 | 3 |
| 1 | 6 | 3 |
| 1 | 7 | 3 |
| 1 | 8 | 3 |
| 1 | 9 | 3 |
| 1 | 10 | 3 |
| 2 | 1 | 3 |
| 2 | 2 | 3 |
| 2 | 3 | 3 |
| 2 | 4 | 3 |
| 2 | 5 | 3 |

TABLE 1-continued

| m | n | p |
|---|---|---|
| 2 | 6 | 3 |
| 2 | 7 | 3 |
| 2 | 8 | 3 |
| 2 | 9 | 3 |
| 2 | 10 | 3 |
| 3 | 1 | 3 |
| 3 | 2 | 3 |
| 3 | 3 | 3 |
| 3 | 4 | 3 |
| 3 | 5 | 3 |
| 3 | 6 | 3 |
| 3 | 7 | 3 |
| 3 | 8 | 3 |
| 3 | 9 | 3 |
| 3 | 10 | 3 |
| 4 | 1 | 3 |
| 4 | 2 | 3 |
| 4 | 3 | 3 |
| 4 | 4 | 3 |
| 4 | 5 | 3 |
| 4 | 6 | 3 |
| 4 | 7 | 3 |
| 4 | 8 | 3 |
| 4 | 9 | 3 |
| 4 | 10 | 3 |
| 5 | 1 | 3 |
| 5 | 2 | 3 |
| 5 | 3 | 3 |
| 5 | 4 | 3 |
| 5 | 5 | 3 |
| 5 | 6 | 3 |
| 5 | 7 | 3 |
| 5 | 8 | 3 |
| 5 | 9 | 3 |
| 5 | 10 | 3 |
| 6 | 1 | 3 |
| 6 | 2 | 3 |
| 6 | 3 | 3 |
| 6 | 4 | 3 |
| 6 | 5 | 3 |
| 6 | 6 | 3 |
| 6 | 7 | 3 |
| 6 | 8 | 3 |
| 6 | 9 | 3 |
| 6 | 10 | 3 |
| 1 | 1 | 4 |
| 1 | 2 | 4 |
| 1 | 3 | 4 |
| 1 | 4 | 4 |
| 1 | 5 | 4 |
| 1 | 6 | 4 |
| 1 | 7 | 4 |
| 1 | 8 | 4 |
| 1 | 9 | 4 |
| 1 | 10 | 4 |
| 2 | 1 | 4 |
| 2 | 2 | 4 |
| 2 | 3 | 4 |
| 2 | 4 | 4 |
| 2 | 5 | 4 |
| 2 | 6 | 4 |
| 2 | 7 | 4 |
| 2 | 8 | 4 |
| 2 | 9 | 4 |
| 2 | 10 | 4 |
| 3 | 1 | 4 |
| 3 | 2 | 4 |
| 3 | 3 | 4 |
| 3 | 4 | 4 |
| 3 | 5 | 4 |
| 3 | 6 | 4 |
| 3 | 7 | 4 |
| 3 | 8 | 4 |
| 3 | 9 | 4 |
| 3 | 10 | 4 |
| 4 | 1 | 4 |
| 4 | 2 | 4 |
| 4 | 3 | 4 |
| 4 | 4 | 4 |
| 4 | 5 | 4 |
| 4 | 6 | 4 |
| 4 | 7 | 4 |
| 4 | 8 | 4 |
| 4 | 9 | 4 |
| 4 | 10 | 4 |
| 5 | 1 | 4 |
| 5 | 2 | 4 |
| 5 | 3 | 4 |
| 5 | 4 | 4 |
| 5 | 5 | 4 |
| 5 | 6 | 4 |
| 5 | 7 | 4 |
| 5 | 8 | 4 |
| 5 | 9 | 4 |
| 5 | 10 | 4 |
| 6 | 1 | 4 |
| 6 | 2 | 4 |
| 6 | 3 | 4 |
| 6 | 4 | 4 |
| 6 | 5 | 4 |
| 6 | 6 | 4 |
| 6 | 7 | 4 |
| 6 | 8 | 4 |
| 6 | 9 | 4 |
| 6 | 10 | 4 |

In some embodiments, the amino acid sequence of the linker includes or consists of a sequence in Table 2.

TABLE 2

| Linker sequence | SEQ ID NO. |
|---|---|
| G | 301 |
| GG | 302 |
| GGG | 303 |
| GGGG | 304 |
| GGGGS | 305 |
| GGGGSG | 306 |
| GGGGSGGGGSGGGG | 307 |
| GGGGSGGGGSGGGGSG | 308 |
| GGGGSGGGGSGGGGSGGGGSGG | 309 |

TABLE 2-continued

| Linker sequence | SEQ ID NO. |
|---|---|
| GGGGSGGGGSGGGGSGGGGSGGGGSGGG | 310 |
| GGGGSGGGGSGGGGSGGGGSGGGGSGGGGSGGGG | 311 |
| GGGGSGGGGSGGGGSGGGGSGGGGSGGGGSGGGGS | 312 |
| GGGGSGGGGSGGGGSGGGGSGGGGSGGGGSGGGGSGGGGSG | 313 |
| KGANKK | 314 |
| KGANQK | 315 |
| KGANKQ | 316 |
| KGANQQ | 317 |
| QGANKK | 318 |
| QGANQK | 319 |
| QGANKQ | 320 |
| QGANQQ | 321 |
| GGGGSGGGGSKGANKK | 322 |
| GGGGSGGGGSKGANQK | 323 |
| GGGGSGGGGSKGANKQ | 324 |
| GGGGSGGGGSKGANQQ | 325 |
| GGGGSGGGGSQGANKK | 326 |
| GGGGSGGGGSQGANQK | 327 |
| GGGGSGGGGSQGANKQ | 328 |
| GGGGSGGGGSQGANQQ | 329 |
| GGGDLQVDTQSQAAWAQLLQEHPNAQQYKGANKK | 330 |
| GGGGSGGGGSGGGGSGGGGSGGGGSGGGKGANKK | 331 |
| GGGGSGGGGSGGGGSGGGGSGGGGSGGGKGANQK | 332 |
| GGGGSGGGGSGGGGSGGGGSGGGGSGGGQGANQQ | 333 |
| QEHPNARKYKGANKK | 334 |
| GQEHPNARKYKGANKK | 335 |
| PGQEHPNARKYKGANKK | 336 |
| SGGGGSGGGGSGGGG | 337 |
| ASTSPANPQPAASSP | 338 |
| PSSAAPQPNAPSTSA | 339 |
| SGGGGSGGGKGANKK | 340 |
| SGGGGSGGGQGANQQ | 341 |
| SGGGGSGGGKGANKQ | 342 |
| SGGGGSGGGKGANQK | 343 |
| SGGGGSGGGQGANKK | 344 |
| SGGGGSGGGKGANQQ | 345 |
| SGGGGSGGGQGANQK | 346 |
| SGGGGSGGGQGANKQ | 347 |
| ASTSPANPQPAASSG | 348 |

TABLE 2-continued

| Linker sequence | SEQ ID NO. |
|---|---|
| GSSAAPQPNAPSTSA | 349 |
| GSSAAPRPNAPSTSAGLSKG | 350 |
| ASTSPANPRPAASSG | 351 |
| HGPQGQEHPNARKYKGANKK | 352 |
| HKLRGQEHPNARKYKGANKK | 353 |
| GHGPQGQEHPNARKYKGANKK | 354 |
| GHKLRGQEHPNARKYKGANKK | 355 |
| GGHGPQGQEHPNARKYKGANKK | 356 |
| GGHKLRGQEHPNARKYKGANKK | 357 |
| GGGHGPQGQEHPNARKYKGANKK | 358 |
| GGGHKLRGQEHPNARKYKGANKK | 359 |
| GGGGHGPQGQEHPNARKYKGANKK | 360 |
| GGGGHKLRGQEHPNARKYKGANKK | 361 |
| GGGGGHGPQGQEHPNARKYKGANKK | 362 |
| GGGGGHKLRGQEHPNARKYKGANKK | 363 |
| HGPQGSGGGSGGGKGANKK | 364 |
| HKLRGSGGGSGGGKGANKK | 365 |
| GGGHGPQGSGGGSGGGKGANKK | 366 |
| GGGHKLRGSGGGSGGGKGANKK | 367 |
| SGGGGQEHPNARKYKGANKK | 368 |
| GGGSGGGGQEHPNARKYKGANKK | 369 |
| SGGGGSGGGSGGGKGANKK | 370 |
| SGGGGSGGGGSGGGGSGGGKGANKK | 371 |
| GGGSGGGGSGGGGSGGGKGANKK | 372 |
| GGGSGGGGSGGGGSGGGGSGGGKGANKK | 373 |
| HGPQG | 374 |
| HKLRG | 375 |
| GHGPQG | 376 |
| GGHGPQG | 377 |
| GGGHGPQG | 378 |
| GGGGHGPQG | 379 |
| GGGGGHGPQG | 380 |
| GHKLRG | 381 |
| GGHKLRG | 382 |
| GGGHKLRG | 383 |
| GGGGHKLRG | 384 |
| GGGGGHKLRG | 385 |
| GGQEHPNARKYKGANKK | 386 |
| GGGQEHPNARKYKGANKK | 387 |

TABLE 2-continued

| Linker sequence | SEQ ID NO. |
|---|---|
| GGGGQEHPNARKYKGANKK | 388 |
| GGGGGQEHPNARKYKGANKK | 389 |

In some embodiments, the linker may include or consist of a [(Gly)$_m$(Ser)]$_n$(Gly)$_p$ or (Gly)$_p$[(Ser)(Gly)$_m$]$_n$ linker as described above, followed by one of SEQ ID NOs: 314-321, e.g., one of SEQ ID NOs: 314, 315, or 321.

In other embodiments, the linker may include or consist of all or a fragment of an NP. For example, the 31-amino acid portion of human CNP53 that is N-terminal to CNP22, or homologs or variants thereof (e.g., residues 4-34 of SEQ ID NO: 320), may be used as a linker. Homologs of this 31-amino acid region may be identified, e.g., by consulting a sequence alignment such as FIGS. 4A-4G and identifying the regions corresponding to the N-terminal 31 amino acids of human CNP53. Other suitable linkers may also be identified, e.g., by choosing any portion of an NP, optionally excluding a ring domain, as shown in FIGS. 4A-4G, or in any other NP or region of an NP not shown in FIGS. 4A-4G. For example, the C-terminal extension of DNP (SEQ ID NO: 117), or fragments or variants thereof, may be used as a linker.

A linker may optionally be glycosylated at any appropriate one or more amino acid residues.

In addition, a linker may have at least 50% (e.g., 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more) sequence identity to any of the linkers described herein. In addition, a linker may have 1, 2, 3, 4, 5, 6, 7, 8, 9, 10, or more additions, deletions, or substitutions relative to any of the linkers described herein.

A linker as described herein may include any other sequence or moiety, attached covalently or non-covalently.

In some embodiments, the linker is absent, meaning that the Fc fragment and the NP are fused together directly, with no intervening residues.

It should be noted that certain Fc-NP or NP-Fc fusion proteins may be viewed, according to the present disclosure, either as 1) having no linker, or as 2) having a linker which corresponds to a portion of the NP. For example, Fc fused directly to CNP53 may be viewed, e.g., either as having no linker, wherein the NP is CNP53, or as having a 31-amino acid linker, wherein the NP is CNP22.

Fusion Polypeptides

Any of the NPs, linkers, and Fc regions described herein may be combined in a fusion polypeptide, e.g., a recombinant fusion polypeptide, that includes the structure X-Fc-Y-NP-Z or the structure X-NP-Y-Fc-Z, wherein each of X, Y (the linker region), and Z is absent or is an amino acid sequence of at least one amino acid.

FIGS. 7A-7E depict several possible schematic structures of fusion polypeptides as described herein. Fc-NP or NP-Fc homodimers may be formed, e.g., due to disulfide bonds formed by Fc (FIGS. 7A and 7B, respectively). Alternative, monomer-dimer hybrids are possible in which an NP-Fc or Fc-NP fusion polypeptide is joined to a free Fc domain (FIGS. 7C and 7D, respectively). Furthermore, an NP-Fc monomer may be joined to an Fc-NP monomer, as shown in FIG. 7E. These configurations not intended to be exhaustive but are merely exemplary.

X may include one or more (e.g., 2, 3, 4, 5, 6, 7, 8, 9, 10, 11, 12, 13, 14, 15, 16, 17, 18, 19, 20, 25, 30, 35, 40, 45, 50, or more) additional amino acids at the N-terminus of the polypeptide, and Z may independently include one or more (e.g., 2, 3, 4, 5, 6, 7, 8, 9, 10, 11, 12, 13, 14, 15, 16, 17, 18, 19, 20, 25, 30, 35, 40, 45, 50, or more) additional amino acids at the C-terminus of the polypeptide.

In some embodiments, the polypeptide includes a bone-targeting moiety, e.g., having a series of consecutive Asp or Glu residues, e.g., $E_6$, $E_7$, $E_8$, $E_9$, $E_{10}$, $E_{11}$, $E_{12}$, $E_{13}$, $E_{14}$, $E_{15}$, $E_{16}$, $D_6$, $D_7$, $D_8$, $D_9$, $D_{10}$, $D_{11}$, $D_{12}$, $D_{13}$, $D_{14}$, $D_{15}$, or $D_{16}$. The bone-targeting moiety, if present, may be positioned anywhere in the fusion polypeptide, e.g., at or near the N-terminal or C-terminal end, and/or in the linker region. For example, any one of X, Y, and/or Z may include a bone-targeting moiety.

In some instances, one or more amino acids are introduced into the fusion polypeptide, e.g., within X, Y, or Z, as a result of the cloning strategy used. In some embodiments, any such additional amino acids, when incorporated into the polypeptide of the invention, do not provide a cleavage site for endoproteases of the host cell. The likelihood that a designed sequence would be cleaved by the endoproteases of the host cell can be predicted as described, e.g., by Ikezawa (Biol. Pharm. Bull. 25:409-417, 2002), hereby incorporated by reference.

The polypeptides of the invention also include any polypeptide having one or more post-translational modifications such as glycosylation (e.g., mannosylation and other forms of glycosylation discussed herein), acetylation, amidation, blockage, formylation, gamma-carboxyglutamic acid hydroxylation, methylation, ubiquitination, phosphorylation, pyrrolidone carboxylic acid modification, and sulfation. Artificial modifications, e.g., pegylation, may also be made.

In certain embodiments, the fusion polypeptides of the invention are associated into dimers, e.g., through two disulfide bonds located in the hinge regions of the Fc fragments.

In some embodiments, the fusion polypeptides of the invention have at least, e.g., 1, 1.5, 2, 2.5, 3, 3.5, 4, 5, 6, 7, 8, 9, 10, 12.5, 15, 20, 25, 30, 35, 40, 45, 50, 75, 100, 125, 150, 175, 200, 250, 300, 350, 400, 450, 500, 600, 700, 800, 900, 1,000, 1,500, 2,000, 3,000, 4,000, 5,000, 7,500, 10,000, 15,000, 20,000, 25,000, 30,000, 40,000, or 50,000 times the half-life of CNP22 in vivo.

Any NP fusion protein may be expressed with an N-terminal signal sequence to facilitate secretion, e.g., amino acids 1-25 of SEQ ID NO: 501, or any other signal sequence known in the art. Such sequences are generally cleaved co-translationally, resulting in secretion of the mature version of the protein.

A fusion polypeptide as described herein may have at least 50% (e.g., 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more) sequence identity to any of the fusion polypeptides described herein, e.g., SEQ ID NOs: 501-608. In addition, a fusion polypeptide as described herein may have 1, 2, 3, 4, 5, 6, 7, 8, 9, 10, 11, 12, 13, 14, 15, 16, 17, 18, 19, 20, 25, 30, 35, 40, 50, or more additions, deletions, or substitutions relative to any of the fusion polypeptides described herein. Furthermore, in some embodiments, a fusion polypeptide as described herein may be encoded by a nucleic acid molecule that hybridizes under high stringency conditions to at least a portion, e.g., to 20%, 30%, 40%, 50%, 60%, 70%, 75%, 80%, 85%, 90%, 95%, 96%, 97%, 98%, 99%, or even 100%, of a nucleic acid molecule that encodes any of the polypeptides, e.g., fusion polypeptides, described herein.

Production of Nucleic Acids and Polypeptides

The nucleic acids and polypeptides of the invention can be produced by any method known in the art. Typically, a nucleic acid encoding the desired fusion protein is generated using molecular cloning methods, and is generally placed within a vector, such as a plasmid or virus. The vector is used to transform the nucleic acid into a host cell appropriate for the expression of the fusion protein. Representative methods are disclosed, for example, in Maniatis et al. (Cold Springs Harbor Laboratory, 1989). Many cell types can be used as appropriate host cells, although mammalian cells are preferable because they are able to confer appropriate post-translational modifications. For example, Human Embryonic Kidney 293 (HEK293) cells have been used as a host for expressing the fusion proteins of the present invention, as described in more detail in the Examples below.

The polypeptides of the invention can be produced under any conditions suitable to effect expression of the polypeptide in the host cell. Such conditions include appropriate selection of a media prepared with components such as a buffer, bicarbonate and/or HEPES, ions like chloride, phosphate, calcium, sodium, potassium, magnesium, iron, carbon sources like simple sugars, amino acids, potentially lipids, nucleotides, vitamins and growth factors like insulin; regular commercially available media like alpha-MEM, DMEM, Ham's-F12 and IMDM supplemented with 2-4 mM L-glutamine and 5% Fetal bovine serum; regular commercially available animal protein free media like Hyclone™ SFM4-CHO, Sigma CHO DHFR⁻, Cambrex POWER™ CHO CD supplemented with 2-4 mM L-glutamine. These media are desirably prepared without thymidine, hypoxanthine and L-glycine to maintain selective pressure, allowing stable protein-product expression.

Additional details of the production of the polypeptides and nucleic acids of the invention are given in the Examples.

Therapeutic Applications

The polypeptides and nucleic acid molecules described herein can have a wide variety of therapeutic applications, e.g., in the fields of disorders associated with overactivation of FGFR3 (e.g., bone and cartilage disorders, e.g., achondroplasia, or cancers, e.g., multiple myeloma) or vascular smooth muscle disorders or bone or cartilage disorders, e.g., that are not associated with overactivation of FGFR3. In addition, the polypeptides and nucleic acid molecules described herein can be used for any condition or disorder that would benefit from elongation of bone.

Disorders Associated with Overactivation of FGFR3

Any disorder, disease, or other abnormality that is caused by, or is associated with, overactivation of FGFR3, e.g., stemming from a gain-of-function FGFR3 mutation, may be treated using the compositions and methods described herein. These disorders, diseases, and other abnormalities include, without limitation, bone or cartilage disorders and cancers, each of which is described in more detail below.

Bone or Cartilage Disorders Associated with Overactivation of FGFR3

Any disorder, disease, or other abnormality, e.g., skeletal dysplasia, that affects the function, structure, or growth of bone or cartilage, may be treated using the compositions and methods described herein. In particular, the disorder may be a skeletal dysplasia that is associated with overactivation of FGFR3, such as achondroplasia, including severe achondroplasia with developmental delay and acanthosis; Muenke syndrome (Muenke coronal craniosynostosis); Crouzonodermoskeletal syndrome; hypochondroplasia; thanatophoric dysplasia type I; and thanatophoric dysplasia type II. The compositions and methods of the invention can also be used to treat bone or cartilage disorders not associated with overactivation of FGFR3, and these disorders are described in more detail below.

Cancers

Any cancer that is caused by, or is associated with, overactivation of FGFR3, may be treated using the compositions and methods described herein. These cancers include, e.g., multiple myeloma, myeloproliferative syndromes, leukemia (e.g., plasma cell leukemia), lymphomas, glioblastoma, prostate cancer, bladder cancer, and mammary cancer.

Bone or Cartilage Disorders

The polypeptides and nucleic acid molecules described herein can be used to treat any disorder, disease, or other abnormality that affects the function, structure, or growth of bone or cartilage. These bone or cartilage disorders may be, but do not necessarily have to be, associated with overactivation of FGFR3.

Skeletal dysplasias are bone or cartilage disorders characterized by short stature or dwarfism. Skeletal dysplasias are typically congenital and may include numerous abnormalities in addition to short stature, e.g., short limbs and trunk; bowlegs; a waddling gait; skull malformations, e.g., a large head, cloverleaf skull, craniosynostosis (premature fusion of the bones in the skull), or wormian bones (abnormal threadlike connections between the bones in the skull); anomalies of the hands and feet, e.g., polydactyly (extra fingers), "hitchhiker" thumbs, and abnormal fingernails and toenails; or chest anomalies, e.g., pear-shaped chest or narrow thorax. Non-skeletal abnormalities may also be present in individuals having skeletal dysplasia, e.g., anomalies of the eyes, mouth, and ears, such as congenital cataracts, myopia, cleft palate, or deafness; brain malformations, such as hydrocephaly, porencephaly, hydranencephaly, or agenesis of the corpus callosum; heart defects, such as atrial septal defect, patent ductus arteriosus, or transposition of the great vessels; developmental delays; or mental retardation. Skeletal dysplasias associated with overactivation of FGFR3 include achondroplasia.

Skeletal dysplasias include achondroplasia (e.g., homozygous or heterozygous achondroplasia), achondrogenesis, acrodysostosis, acromesomelic dysplasia, atelosteogenesis, camptomelic dysplasia, chondrodysplasia punctata (e.g., rhizomelic type of chondrodysplasia punctata), cleidocranial dysostosis, congenital short femur, dactyly (e.g., brachydactyl), camptodactyl), polydactyl), or syndactyly, diastrophic dysplasia, dwarfism, dyssegmental dysplasia, enchondromatosis, fibrochondrogenesis, fibrous dysplasia, hereditary multiple exostoses, hypochondroplasia, hypophosphatasia, hypophosphatemic rickets, Jaffe-Lichtenstein syndrome, Kniest dysplasia, Kniest syndrome, Langer-type mesomelic dysplasia, Marfan syndrome, McCune-Albright syndrome, micromelia, metaphyseal dysplasia (e.g., Jansen-type metaphyseal dysplasia), metatrophic dysplasia, Morquio syndrome, Nievergelt-type mesomelic dysplasia, neurofibromatosis (e.g., type 1, e.g., with bone manifestations or without bone manifestations; type 2; or schwannomatosis), osteoarthritis, osteochondrodysplasia, osteogenesis imperfecta (e.g., perinatal lethal type of osteogenesis imperfecta), osteopetrosis, osteopoikilosis, peripheral dysostosis, Reinhardt syndrome, Roberts syndrome, Robinow syndrome, short-rib polydactyly syndromes, short stature, spondyloepiphyseal dysplasia congenita, spondyloepimetaphyseal dysplasia, or thanatophoric dysplasia.

In particular, some forms of craniosynostosis are the result of mutations in one of the fibroblast growth factor receptors (e.g., one or more of FGFR1, FGFR2, or FGFR3) that cause the activation of the MAPK pathway. This is the case for Muenke (Muenke coronal craniosynostosis), Crouzon, Apert, Jackson-Weiss, Pfeiffer, and Crouzonodermoskeletal syndromes, for example. There is genetic and biochemical evidence in the scientific literature that agents that can prevent activation of the MAP-kinase (ERK 1/2) can prevent craniosynostosis in animal models. In particular, use of a MEK1/2 inhibitor (e.g., U0126), which prevents activation of ERK 1/2 can prevent craniosynostosis in an animal model of Apert syndrome (Shukla et al., *Nat. Genet.* 39:1145, 2007). Accordingly, the compounds of the present invention, which can prevent activation of the MAP-kinase pathway, could be used to treat these forms of craniosynostosis.

Achondroplasia

Achondroplasia is an autosomal dominant skeletal dysplasia that is the most common cause of dwarfism in humans. Its incidence is approximately 1 in 20,000 live births. Skeletal manifestations include growth retardation (with an average adult height of 123-131 cm (4 feet ½ in.-4 feet 3½ in.)), skull deformities, and orthodontic defects. Extraskeletal manifestations include cervical cord compression (with risk of death, e.g., from central apnea or seizures); spinal stenosis (e.g., leg and lower back pain); hydrocephalus (e.g., requiring cerebral shunt surgery); hearing loss due to chronic otitis; cardiovascular disease; neurological disease; higher frequency of accidents; and obesity.

Babies are often diagnosed at birth. While the homozygous form is usually lethal, individuals diagnosed with the heterozygous form have a life expectancy, on average, of 15 years less than the normal population.

Heterozygous or homozygous achondroplasia, or any of its manifestations or phenotypes, can be treated using the compositions and methods described herein. Treatment of either form may be started as early as possible in the patient's life, e.g., shortly after birth, or even in utero; this is particularly important for treatment of the homozygous form, which is typically much more severe and is often lethal if untreated.

Vascular Smooth Muscle Disorders

The polypeptides and nucleic acid molecules described herein can be used to treat any disorder, disease, or other abnormality that affects the function, structure, or growth of vascular smooth muscle. Exemplary vascular smooth muscle disorders are hypertension, restenosis, arteriosclerosis, acute decompensated heart failure, congestive heart failure, cardiac edema, nephredema, hepatic edema, acute renal insufficiency, and chronic renal insufficiency.

Conditions for Elongation of Bone

Any condition, disorder, disease, or other abnormality that would benefit from elongation of bone may be treated using the compositions and methods described herein. These conditions, disorders, diseases, and other abnormalities include, without limitation, insufficient or impaired bone growth arising from fractures, renal failure or insufficiency, poor diet, vitamin deficiency, or hormone deficiency. Healthy subjects, e.g., those without any conditions, disorders, diseases, or other abnormalities related to bone or cartilage, may also be treated using the compositions and methods described herein, e.g., for cosmetic purposes.

Skeletal dysplasias are also associated with shortened segments of long bones. Exemplary skeletal dysplasias include those associated with rhizomelia (or shortening in a proximal segment of a limb, e.g., in the humerus or femur), such as achondroplasia, atelosteogenesis, congenital short femur, diastrophic dysplasia, hypochondroplasia, Jansen type of metaphyseal dysplasia, rhizomelic type of chondrodysplasia punctata, spondyloepiphyseal dysplasia congenita, and thanatophoric dysplasia; mesomelia (or shortening in a middle segment of a limb, e.g., in the radius, ulna, tibia, or fibula), such as Langer and Nievergelt types of mesomelic dysplasias, Robinow syndrome, and Reinhardt syndrome; acromelia (or shortening in a distal segment of a limb, e.g., in the metacarpals or phalanges), such as acrodysostosis and peripheral dysostosis; acromesomelia (or shortening in the middle and distal segments of limbs, e.g., in the forearms and hands), such as acromesomelic dysplasia; micromelia (or shortening in the entire limb), such as achondrogenesis, fibrochondrogenesis, dyssegmental dysplasia, Kniest dysplasia, and Roberts syndrome; or short-trunk, such as Dyggve-Melchior-Clausen disease, Kniest syndrome, metatrophic dysplasia, Morquio syndrome, spondyloepimetaphyseal dysplasia, and spondyloepiphyseal dysplasia congenita.

Formulation

Formulation will depend on the route of administration, as well as on other therapeutic goals. The polypeptides and nucleic acid molecules described herein can be administered by any route known in the art, e.g., subcutaneous (e.g., by subcutaneous injection), intravenously, orally, nasally, intramuscularly, sublingually, intrathecally, or intradermally. By way of example, pharmaceutical compositions of the invention can be in the form of a liquid, solution, suspension, pill, capsule, tablet, gelcap, powder, gel, ointment, cream, nebulae, mist, atomized vapor, aerosol, or phytosome.

In some embodiments of the invention, the compositions of the invention can be administered subcutaneously. Subcutaneous administration is advantageous because it is relatively non-invasive and offers desirable pharmacokinetic profiles. Suitable volumes are known to those skilled in the art, and are typically 5 mL or smaller (e.g., 4 mL, 3.5 mL, 3 mL, 2.7 mL, 2.5 mL, 2.3 mL, 2.2 mL, 2.1 mL, 2.0 mL, 1.9 mL, 1.8 mL, 1.7 mL, 1.5 mL, 1.3 mL, 1.0 mL, 0.7 mL, 0.5 mL, 0.3 mL, 0.1 mL, 0.05 mL, 0.01 mL, or smaller). Typically, the compositions of the invention can be formulated at a concentration between 1 mg/mL and 500 mg/mL (e.g., between 10 mg/mL and 300 mg/mL, 20 mg/mL and 120 mg/mL, 40 mg/mL and 200 mg/mL, 30 mg/mL and 150 mg/mL, 40 mg/mL and 100 mg/mL, 50 mg/mL and 80 mg/mL, or 60 mg/mL and 70 mg/mL) for subcutaneous administration. For oral administration, tablets or capsules can be prepared by conventional means with pharmaceutically acceptable excipients such as binding agents, fillers, lubricants, disintegrants, or wetting agents. The tablets can be coated by methods known in the art. Liquid preparations for oral administration can take the form of, for example, solutions, syrups, or suspension, or they can be presented as a dry product for constitution with saline or other suitable liquid vehicle before use. Compositions of the invention for oral administration also can contain pharmaceutically acceptable excipients such as suspending agents, emulsifying agents, non-aqueous vehicles, preservatives, buffer salts, flavoring, coloring, and sweetening agents as appropriate. Preparations for oral administration also can be suitably formulated to give controlled release of the active ingredients.

Enteric coatings can further be used on tablets of the present invention to resist prolonged contact with the strongly acidic gastric fluid, but dissolve in the mildly acidic or neutral intestinal environment. Without being so limited, cellulose acetate phthalate, Eudragit™ and hydroxypropyl methylcellulose phthalate (HPMCP) can be used in enteric coatings of pharmaceutical compositions of the present invention. Cellulose acetate phthalate concentrations generally used are 0.5-9.0% of the core weight. The addition of plasticizers improves the water resistance of this coating material, and formulations using such plasticizers are more effective than when cellulose acetate phthalate is used alone. Cellulose acetate phthalate is compatible with many plasticizers, including acetylated monoglyceride; butyl phthalybutyl glycolate; dibutyl tartrate; diethyl phthalate; dimethyl phthalate; ethyl phthalylethyl glycolate; glycerin; propylene glycol; triacetin; triacetin citrate; and tripropionin. It is also used in combination with other coating agents such as ethyl cellulose, in drug controlled-release preparations.

The compounds of the invention may be administered in combination with pharmaceutically acceptable, sterile, aqueous or non-aqueous solvents, suspensions or emulsions. Examples of nonaqueous solvents are propylene glycol, polyethylene glycol, vegetable oil, fish oil, and injectable organic esters. Aqueous carriers include water, water-alcohol solutions, emulsions or suspensions, including saline and buffered medical parenteral vehicles including sodium chloride solution, Ringer's dextrose solution, dextrose plus sodium chloride solution, Ringer's solution containing lactose, or fixed oils. Intravenous vehicles may include fluid and nutrient replenishers, electrolyte replenishers, such as those based upon Ringer's dextrose, and the like.

In some embodiments, the pharmaceutical compositions of the present invention can be delivered in a controlled release system. In some embodiments, polymeric materials including polylactic acid, polyorthoesters, cross-linked amphipathic block copolymers and hydrogels, polyhydroxy butyric acid and polydihydropyrans can be used (see also Smolen and Ball, Controlled Drug Bioavailability, Drug product design and performance, 1984, John Wiley & Sons; Ranade and Hollinger, Drug Delivery Systems, pharmacology and toxicology series, 2003, $2^{nd}$ edition, CRRC Press). In another embodiment, a pump may be used (Saudek et al., 1989, N. Engl. J. Med. 321: 574).

The compositions of the invention could be formulated in the form of a lyophilized powder using appropriate excipient solutions (e.g., sucrose) as diluents.

Furthermore, cells can be isolated from an individual having a disorder associated with overactivation of FGFR3, e.g., achondroplasia, a bone or cartilage disorder, or a vascular smooth muscle disorder or from an individual that would benefit from bone elongation; transformed with a nucleic acid of the invention; and reintroduced to the afflicted individual (e.g., subcutaneous or intravenous injection). Alternatively, the nucleic acid can be administered directly to the afflicted individual, for example, by injection. The nucleic acid can also be delivered through a vehicle such as a liposome, which can be designed to be targeted to a specific cell type, and engineered to be administered through different routes.

The compositions of the present invention may also be used in combination with at least one other active ingredient to correct, e.g., an achondroplasia phenotype.

Gene Therapy

The polypeptides described herein could also be advantageously delivered through gene therapy, where an exogenous nucleic acid encoding the proteins is delivered to tissues of interest and expressed in vivo. Gene therapy methods are discussed, e.g., in Verme et al. (*Nature* 389:239-242, 1997), Yamamoto et al. (*Molecular Therapy* 17:S67-S68, 2009), and Yamamoto et al., *J. Bone Miner. Res.* 26:135-142, 2011), each of which is hereby incorporated by reference. Both viral and non-viral vector systems can be used. The vectors may be, for example, plasmids, artificial chromosomes (e.g., bacterial, mammalian, or yeast artificial chromosomes), virus or phage vectors provided with an origin of replication, and optionally, a promoter for the expression of the nucleic acid encoding the viral polypeptide and optionally, a regulator of the promoter. The vectors may contain one or more selectable marker genes, for example, an ampicillin or kanamycin resistance gene in the case of a bacterial plasmid or a resistance gene for a fungal vector. Vectors may be used in in vitro, for example, for the production of DNA, RNA, or the viral polypeptide, or may be used to transfect or transform a host cell, for example, a mammalian host cell, e.g., for the production of the viral polypeptide encoded by the vector. The vectors may also be adapted to be used in vivo, for example, in a method of vaccination or gene therapy.

Examples of suitable viral vectors include, retroviral, lentiviral, adenoviral, adeno-associated viral, herpes viral, including herpes simplex viral, alpha-viral, pox viral, such as Canarypox and vaccinia-viral based systems. Gene transfer techniques using these viruses are known in the art. Retrovirus vectors, for example, may be used to stably integrate the nucleic acids of the invention into the host genome. Replication-defective adenovirus vectors by contrast remain episomal and therefore allow transient expression. Vectors capable of driving expression in insect cells (e.g., baculovirus vectors), in human cells, yeast, or in bacteria may be employed in order to produce quantities of the viral polypeptide(s) encoded by the nucleic acids of the invention, for example, for use in subunit vaccines or in immunoassays. Useful gene therapy methods include those described in WO 06/060641, U.S. Pat. No. 7,179,903 and WO 01/36620 (each of which is hereby incorporated by reference), which use an adenovirus vector to target a nucleic acid of interest to hepatocytes as protein producing cells.

In an additional example, a replication-deficient simian adenovirus vector may be used as a live vector. These viruses contain an E1 deletion and can be grown on cell lines that are transformed with an E1 gene. Examples of these replication-deficient simian adenovirus vectors are described in U.S. Pat. No. 6,083,716 and WO 03/046124 (each of which is hereby incorporated by reference). These vectors can be manipulated to insert a nucleic acid of the invention, such that the encoded viral polypeptide(s) may be expressed.

Promoters and other expression regulatory signals may be selected to be compatible with the host cell for which expression is designed. For example, mammalian promoters include the metallothionein promoter, which can be induced in response to heavy metals such as cadmium, and the β-actin promoter. Viral promoters, such as the SV40 large T antigen promoter, human cytomegalovirus (CMV) immediate early (1E) promoter, rous sarcoma virus LTR promoter, adenovirus promoter, or a HPV promoter, particularly the HPV upstream regulatory region (URR) may also be used. All these promoters, as well as additional promoters, are well-described in the art.

The nucleic acid molecules described herein may also be administered using non-viral based systems. For example, these administration systems include microsphere encapsulation, poly(lactide-co-glycolide), nanoparticle, and liposome-based systems. Non-viral based systems also include techniques facilitating the delivery of "naked" polynucleotides (such as electroporation, "gene gun" delivery and various other techniques used for the introduction of polynucleotides).

The introduced polynucleotide can be stably or transiently maintained in the host cell. Stable maintenance typically requires that the introduced polynucleotide either contains an origin of replication compatible with the host cell or integrates into a replicon of the host cell such as an extrachromosomal replicon (e.g., a plasmid) or a nuclear or mitochondrial chromosome.

Dosage

Any amount of a pharmaceutical composition of the invention can be administered to a subject. The dosages will depend on many factors, including the mode of administration and the age of the subject. Typically, the amount of the composition of the invention contained within a single dose will be an amount that is effective to treat a disorder associated with overactivation of FGFR3, a bone or cartilage disorder, or a vascular smooth muscle disorder, or to elongate bone, without inducing significant toxicity. For example, the polypeptides described herein can be administered to subjects in individual doses ranging, e.g., from 0.01 mg/kg to 500 mg/kg (e.g., from 0.05 mg/kg to 500 mg/kg, from 5 mg/kg to 500 mg/kg, from 0.1 mg/kg to 100 mg/kg, from 10 mg/kg to 100 mg/kg, from 0.1 mg/kg to 50 mg/kg, 0.5 mg/kg to 25 mg/kg, 1.0 mg/kg to 10 mg/kg, 1.5 mg/kg to 5 mg/kg, or 2.0 mg/kg to 3.0 mg/kg) or from 1 µg/kg to 1,000 µg/kg (e.g., from 5 µg/kg to 1,000 µg/kg, from 1 µg/kg to 750 µg/kg, from 5 µg/kg to 750 µg/kg, from 10 µg/kg to 750 µg/kg, from 1 µg/kg to 500 µg/kg, from 5 µg/kg to 500 µg/kg, from 10 µg/kg to 500 µg/kg, from 1 µg/kg to 100 µg/kg, from 5 µg/kg to 100 µg/kg, from 10 µg/kg to 100 µg/kg, from 1 µg/kg to 50 µg/kg, from 5 µg/kg to 50 µg/kg, or from 10 µg/kg to 50 µg/kg). Exemplary doses include, e.g., 0.01, 0.05, 0.1, 0.5, 1, 2, 2.5, 5, 10, 20, 25, 50, 100, 125, 150, 200, 250, or 500 mg/kg; or 1, 2, 2.5, 5, 10, 20, 25, 50, 100, 125, 150, 200, 250, 500, 750, 900, or 1,000 µg/kg. For all dosages or ranges recited herein, the term "about" may be used to modify these dosages by ±10% of the recited values or range endpoints.

Doses can be administered, e.g., hourly, bihourly, daily, bidaily, twice a week, three times a week, four times a week, five times a week, six times a week, weekly, biweekly, monthly, bimonthly, or yearly. Alternatively, doses can be administered, e.g., twice, three times, four times, five times, six times, seven times, eight times, nine times, 10 times, 11 times, or 12 times per day. In particular preferred embodiments, the dosing regimen is once weekly. The duration of the dosing regimen can be, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 day(s), week(s), or month(s), or even for the remaining lifespan of the subject. The amount, frequency, and duration of dosage will be adapted by the clinician in accordance with conventional factors such as the extent of the disease and different parameters from the subject.

The nucleic acids of the invention can be administered according the formulations described herein to a patient in dosages suitable for gene therapy. The amount of the nucleic acids administered will depend on a number of factors known to those skilled in the art, including: the length and nature of the nucleic acid, the vector (e.g., viral or non-viral) used, the activity of the polypeptide encoded, the presence of excipients, the route and method of administration, and the general condition and fitness of the subject. Exemplary dosages and routes of administration are described, e.g., in Melman et al. (*Isr. Med. Assoc. J.* 9:143-146, 2007; describing the intrapenile injection of 0.5 mg to 7.5 mg of a human cDNA in a plasmid for treating erectile dysfunction), Powell et al. (*Circulation* 118:58-65, 2008; describing the intramuscular injection of 0.4 mg to 4.0 mg of a hepatocyte growth factor plasmid to treat critical limb ischemia, Waddill et al. (*AJR Am. J. Roentgenol.* 169:63-67, 1997; describing the CT-guided intratumoral injection of 0.01 mg to 0.25 mg of plasmid DNA encoding an MHC antigen to treat melanoma), Kastrup et al. (*J. Am. Coll. Cardiol.* 45:982-988, 2005; describing the intramyocardial injection of 0.5 mg of a VEGF plasmid to treat severe angina pectoris), and Romero et al. (*Hum. Gene. Ther.* 15:1065-1076, 2004; describing the intramuscular injection of 0.2 mg to 0.6 mg of a plasmid to treat Duchenne/Becker muscular dystrophy), each of which is hereby incorporated by reference.

In certain embodiments, the nucleic acids of the invention can be administered to the subject at a dose in the range from, e.g., 0.01 mg to 100 mg (e.g., from 0.05 mg to 50 mg, 0.1 mg to 10 mg, 0.3 mg to 3 mg, or about 1 mg) of nucleic acid. The total volume at which the nucleic acid can be administered will depend on its concentration, and can range from, e.g., 1 µL to 10 mL (e.g. from 10 µL to 1 mL, 50 µL to 500 µL, 70 µL to 200 µL, 90 µL to 150 µL or 100 µL to 120 µL).

The nucleic acids can be administered, e.g., hourly, bihourly, daily, bidaily, twice a week, three times a week, four times a week, five times a week, six times a week, weekly, biweekly, monthly, bimonthly, or yearly. Alternatively, the nucleic acids can be administered, e.g., twice, three times, four times, five times, six times, seven times, eight times, nine times, 10 times, 11 times, or 12 times per day. The duration of the dosing regimen can be, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 day, weeks, or months, or even for the remaining lifespan of the subject.

These are guidelines, since the actual dose should be carefully selected and titrated by an attending physician or nutritionist based upon clinical factors unique to each subject. The optimal periodic dose will be determined by methods known in the art and will be influenced by factors such as the age of the subject, as indicated above, and other clinically relevant factors. In addition, subjects may be taking medications for other diseases or conditions. The other medications may be continued during the time that a polypeptide or nucleic acid of the invention is given to the subject, but it is advisable in such cases to begin with low doses to determine if adverse side effects are experienced.

EXAMPLES

The examples provided below are intended to illustrate the invention, not limit it.

Example 1

Cloning, Production, and Purification of NC2 Streptag

An Fc-CNP fusion protein was designed as shown in FIGS. 8A and 8B. This protein, termed "NC2 Streptag" or "NC2st," has a 25-amino acid N-terminal signal sequence that is cleaved during expression. The mature protein has the following domain structure, from N terminus to C terminus: Strep-tag II sequence (to facilitate purification) flanked by short linker sequences; TEV protease cleavage sequence, followed by a short linker; Fc domain of human IgG-1; 16-amino acid glycine-rich linker; and CNP22.

The coding sequence for NC2st was chemically synthesized (FIG. 8C, SEQ ID NO: 801) and inserted in a small cloning plasmid using standard techniques known in the art. The coding sequence of NC2st was then inserted in a mammalian expression vector and transiently transfected in a proprietary HEK293 cell line (Biotechnology research institute, NRCC, Animal Cell Technology Group, Montreal). NC2st was secreted in the culture medium for seven days prior to harvesting of culture supernatant.

Culture supernatant containing NC2st protein was concentrated 10-fold by tangential flow filtration, filtered on 0.45 µm membrane in sterile conditions and kept at 4° C. Concentrated harvest was sterile filtered on 0.22 µm membrane prior to loading onto a 180 mL Streptactin column (IBA GmbH). Purification was performed on an AKTA FPLC system, utilizing Unicorn control software. Streptactin column was first equilibrated with 5 CV of 100 mM Tris-Cl, 150 mM NaCl, 1 mM EDTA, pH 8.0, then concentrated harvest was loaded using a 5 minutes contact time, and column was washed with 6 CV of 100 mM Tris-Cl, 150 mM NaCl, 1 mM EDTA, pH 8.0. NC2st protein was eluted in steps by pausing two minutes between each elution fraction with 10×0.5 CV of 100 mM Tris-Cl, 150 mM NaCl, 1 mM EDTA, 2.5 mM desthiobiotin, pH 8.0. Eluate was then dialyzed, concentrated and formulated in 25 mM sodium phosphate, 150 mM NaCl, pH 7.4.

Alternatively, CNP-Fc or Fc-CNP proteins were purified on protein A sorbent (MabSelect SuRe, GE Healthcare). A 180 mL column was first equilibrated with 5 column volumes (CV) of EQ buffer (50 mM NaPO$_4$, 100 mM NaCl, pH 7.5). After loading the column with ~1 L of harvest media containing ~2.4 g/L of Fc-CNP, the column was washed with 3 CV of EQ buffer, 4 CV of Wash2 buffer (100 mM sodium citrate, 1.5 M NaCl, pH 6.0), and 3 CV of Wash3 buffer (100 mM sodium citrate pH 6.0). The protein was then eluted using 3 CV of elution buffer (100 mM sodium citrate, 0.1M L-Arginine, pH 3.5) into an appropriate container containing 67% of the elution volume of neutralization buffer (1.5 M Tris-Cl pH 7.6). The purified protein was finally concentrated and dialysed against phosphate buffer (25 mM NaPO$_4$, 150 mM NaCl, pH 7.4) using 10 kDa cutoff Vivaspin units (Sartorius VS2022) or a TFF 10 kDa Kvick Lab SCU unit (GE healthcare). The overall yield of the purification procedure was ~80%, with purity surpassing 95% as assessed by SYPRO® Ruby stained 4-12% SDS-PAGE (Invitrogen Inc.) and size exclusion HPLC. The purified protein preparations were stored at 4-6° C. and remained stable for several months.

Example 2

Whole Cell Guanylyl Cyclase Assay

HEK293S cells in a semi-confluent 75 cm2 flask are transfected with 30 µg of plasmid DNA coding for the appropriate receptor, e.g., human NPR-B or NPR-A, using Lipofectamine-2000CD. Alternatively, a stable polyclonal HEK293 S cell line expressing either human NPR-B or NPR-A was used. 24 hours after transfection, cells are trypsinized and plated into 48-well plates at 1×10$^5$ cells/well. Guanylyl cyclase assay is carried out 24 hours post-plating. Cells are first incubated for 30 minutes at 37° C. with serum-free DMEM medium. Then, they are incubated in triplicate with or without increasing concentrations of reference or test proteins in serum-free DMEM supplemented with 1 mM IBMX and 0.5% BSA, at 37° C. for 30 minutes to one hour. CNP serves as a suitable reference for NPR-B, while ANP is a suitable reference for NPR-A. Finally, cells are washed with ice-cold PBS and solubilized in lysis buffer from Catchpoint cGMP kit (Molecular devices). Concentrations of cGMP in lysate are determined using the Catchpoint cGMP kit. Dose-response curves are analysed with GraphPad Prism 5 software using non-linear regression with four-parameter logistic equation.

Example 3

Membrane Guanylyl Cyclase Assay

HEK293 cells expressing either NPR-B or NPR-A are used to prepare crude membrane preparations: Cells are resuspended in TH buffer (50 mM Hepes, 50 mM NaCl, pH 7.4, 10% glycerol, Protease inhibitor tablet (Roche cat. number 11697498001, one tablet for 35 mL of buffer), 50 mM sodium fluoride, 10 mM sodium pyrophosphate, 25 mM glycerol 2-phosphate) and homogenized using a polytron homogenizer. After centrifugation for 30 minutes at 38,000 g, cells are homogenized again and this washing procedure is repeated two more times. The crude membrane pellet is then homogenized in FB buffer (50 mM Hepes, 50 mM NaCl, 250 mM sucrose, 1 mM MgCl$_2$, pH 7.4, 10% glycerol, Protease inhibitor cocktail (Roche cat. number 11873580001, one tablet for 25 mL of buffer), 50 mM sodium fluoride, 25 mM glycerol 2-phosphate), aliquoted at 200 µL into 1.5 mL eppendorf tubes and quickly frozen in liquid nitrogen before storing at −80° C. Membranes are then used to generate cGMP dose-response curves by adding increasing concentrations of agonist peptides or proteins to 10 µg of crude preparation in 100 µL of buffer A (25 mM HEPES, 50 mM NaCl pH 7.5) containing 1 mM GTP, 1 mM ATP, 10 mM theophyllin, 2 mM IBMX, 100 U/mL of creatine kinase, 10 mM creatine phosphate, 5 mM MgCl$_2$, into a 1.2 mL deep-well plate. Plate is incubated for 15-20 minutes in a 37° C. water bath before adding 500 µL of ice-cold 110 mM zinc acetate to each well and placing the plates on ice. After addition of 500 µL of 110 mM sodium carbonate to each well, plates are agitated on a plate shaker at 600 rpm for two minutes. Content of each well is transferred to a 1.5 mL eppendorf tube and centrifuged five minutes at 20,000 g. Supernatant is transferred to a new 1.5 mL eppendorf tube. cGMP concentrations are determined using the Catchpoint cGMP kit. Dose-response curves are analysed with GraphPad Prism 5 software using non-linear regression with four-parameter logistic equation.

It should be noted that, in general, membrane assays for NPR-B result in significantly higher (less potent) EC$_{50}$ values than corresponding whole cell assays; thus, absolute EC$_{50}$ measurements in whole cell assays should generally not be compared to absolute EC$_{50}$ determinations in membrane assays. When comparing results across assay types, it is more instructive to compare relative EC$_{50}$ ratios between a test compound and a control compound than to compare absolute EC$_{50}$ values.

Example 4

In Vivo Pharmacokinetic Study of NC2st Administered IV or SC in C57BL/6 Mice

Objective

The objectives of this study were the determination of the non-compartmental pharmacokinetic parameters of NC2st following intravenous and subcutaneous administration to mice and the calculation of its subcutaneous bioavailability.

Experimental Design

NC2st was formulated at a concentration of 5.79 mg/mL in 25 mM sodium phosphate pH 7.4, 150 mM NaCl. The animals received NC2st as a single IV or SC dose (20 mg/kg) as described in Table 3 below.

TABLE 3

| Group No. | Group description | Dose Level (mg/kg) | Bleeding schedule | Animals No. Males |
|---|---|---|---|---|
| 1 | NC2 Streptag IV | 20 | 0.5, 21 and 26 hr post dose<br>1, 8 and 49 hr post dose<br>3, 12 and 32 hr post dose | 101, 102, 103<br>104, 105, 106<br>107, 108, 109 |

TABLE 3-continued

| Group No. | Group description | Dose Level (mg/kg) | Bleeding schedule | Animals No. Males |
|---|---|---|---|---|
| 2 | NC2 Streptag SC | 20 | 6, 21 and 26 hr post dose<br>1, 8 and 49 hr post dose<br>3, 12 and 32 hr post dose | 201, 202, 203<br>204, 205, 206<br>207, 208, 209 |

Injections were scheduled between 7:00 and 10:15 AM. Each mouse was injected with test article subcutaneously into the scapular region or immobilized in a rodent restrainer and injected with the test article as an intravenous bolus via the caudal vein. The dose volume was set at 3.45 mL/kg. The animals received only one dose before scheduled blood collection and sacrifice. Individual body weights were assessed before scheduled test article injection and the volume of test article administered was based on body weight determination.

Blood Collection

Blood samples (0.1 to 0.12 mL) were collected via a jugular vein under isoflurane anesthesia at different time points. At the last time point, blood samples were collected by cardiac puncture under isoflurane anesthesia.

Blood samples were collected into Microvette 200Z/gel tube (Sarstedt, serum/gel clotting activator, #20.1291), incubated at room temperature for 30 to 60 minutes, and centrifuged at 10,000×g for five minutes at 2-8° C. Serum was then transferred into a fresh 0.5 mL tube (Sarstedt, #72.699), snap-frozen in liquid nitrogen, and stored at −80° C. until analysis.

Test Article Concentration in Serum

The presence of NC2st in serum samples was assessed using a CNP22 fluorescent EIA kit (Phoenix Pharmaceuticals, cat# FEK-012-03). Formulated NC2st protein spiked in serum served as a standard. Pharmacokinetic profiles were derived from the concentration measured by EIA.

Terminal Procedure

Animals were sacrificed by bilateral thoracotomy under isoflurane anesthesia following collection of their last sample.

Non-Compartmental Pharmacokinetic Analysis

A non-compartmental analysis (NCA) was used to calculate the pharmacokinetic parameters of testing compound. All measured serum concentrations of testing compound versus time profile were processed using WinNonlin™ Enterprise Edition version 5.2.12. NCA Model 200 was selected for extravascular input or Model 201 for IV-Bolus input using sparse sampling analysis module for both models.

The following non-compartmental PK parameters were calculated:
  Area under the curve from time zero to the last detectable concentration ($AUC_{last}$), calculated using the linear trapezoidal (linear interpolation);
  Area under the curve from time zero to infinity ($AUC_\infty$) calculated as $AUC_{last}+C_{last}/\lambda_z$ (where $\lambda_z$=slope of the terminal phase of the serum concentration vs time curve);
  Maximum observed serum concentration ($C_{max}$), time of maximum serum concentration ($T_{max}$);
  Terminal elimination half-life ($T_{1/2}$, calculated as $0.693/\lambda_z$);
  Systemic clearance (CL) was calculated as Dose/$AUC_\infty$ and
  Total volume of distribution ($V_{ss}$) was calculated using CL×MRT, where MRT is the mean residence time.
  Absolute bioavailability (F %) between routes was calculated using the following formula: [$AUC_\infty$ (sc)/Dose(sc)]/[$AUC_\infty$ (iv)/Dose(iv)]×100.

Nominal times were used in the calculations and times are set relative to start of dosing. Nominal doses were used for the calculation of CL.

Results

Figure 9:
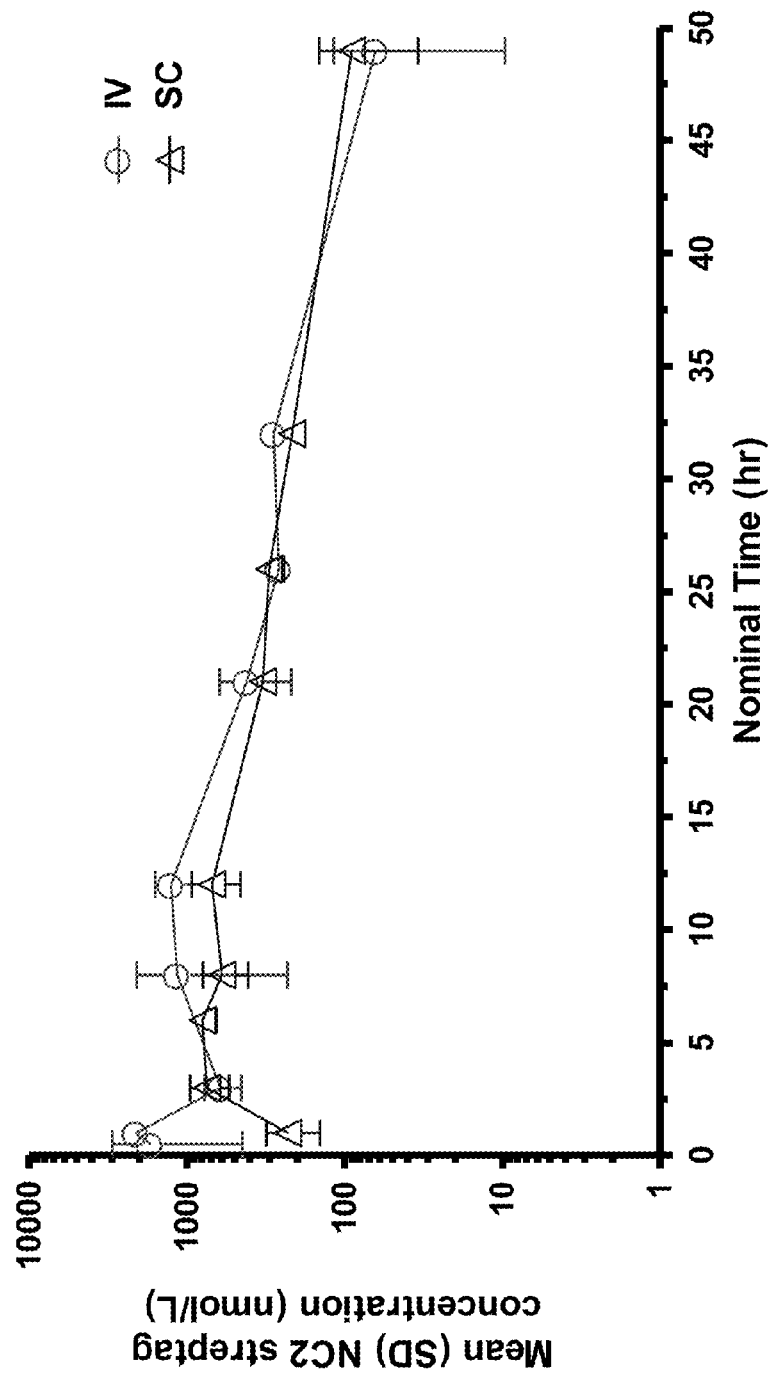
FIG. 9 is a graph showing the results of a mouse study analyzing the non-compartmental pharmacokinetic parameters of NC2st following intravenous and subcutaneous administration to mice.

Mean (±SC) serum concentrations of NC2st in male mice following IV and SC administration are shown in FIG. 9.

Non-compartmental pharmacokinetic parameters of NC2st in male mouse serum are summarized in Table 4.

TABLE 4

| PK Parameters | Units | IV | SC |
|---|---|---|---|
| $AUC_{last}$ | hr · nmol/L | 27,587 | 17,735 |
| $AUC_\infty$ | hr · nmol/L | 28,563 | 19,592 |
| $C_{max}$ | nmol/L | 2,099 | 798 |
| $T_{max}$ | hr | 1.00 | 6.00 |
| Half-life | hr | 10.6 | 14.3 |
| CL | L/hr/kg | 0.0112 | |
| CL_F | L/hr/kg | | 0.0163 |
| Vss | L/kg | 0.173 | |
| Vss_F | L/kg | | 0.353 |
| Bioavailability | % | | 68.5 |

Following IV administration of 20 mg/kg (320 nmol/L) of NC2st in male mice, the exposure PK parameter $AUC_\infty$ was 28,563 nmol·h/L and $C_{max}$ was 2,099 nmol/L;

Following SC administration of 20 mg/kg (320 nmol/L) of NC2st in male mice, the exposure PK parameter $AUC_\infty$ was 19,592 nmol·h/L and $C_{max}$ was 798 nmol/L;

The estimated bioavailable fraction (% F) was 68.5% following SC administration in male mice; and The estimated SC half-life was 14.3 hours, an approximately 340-fold increase over intravenous CNP22.

In summary, it was determined that NC2st has very favorable pharmacokinetic properties, including a greatly increased half-life, high AUC values, and high bioavailability via the SC route of administration.

Example 5

Evaluation of the Efficacy of Subcutaneous Administration of NC2st on Rescue of the ACH Bone Phenotype in Fgfr3[369/+] Mice Objective The study was designed to evaluate the effect of daily subcutaneous (SC) administration of NC2 Streptag (NC2st) on rescue of the achondroplasia skeletal disorders in the mouse model of the disease, the Fgfr3[369/+] mice.

Test and Control Articles

Test article: NC2st formulated in 25 mM sodium phosphate, 150 mM NaCl, pH 7.4.

Control article: Vehicle, 25 mM sodium phosphate, 150 mM NaCl, pH 7.4.

Test System

Fgfr3[369/+] mice were created by an amino acid substitution (Gly to Cys) at position 369 in the mouse Fibroblast Growth Factor Receptor 3 (Fgfr3) gene (Chen et al., J. Clin. Invest. 104(11): 1517-1525, 1999). Substitution 369 (Gly369Cys) in mouse Fgfr3 gene causes dwarfism with features mimicking human achondroplasia. The Fgfr3[369/+] mice exhibit macrocephaly and shortened limbs due to retarded endochondral bone growth and premature closure of cranial base synchondroses. Mutant mice showed disorganized growth plates, delayed formation of the secondary ossification center and reduced bone density. Thus, the Fgfr3[369/+] mouse is an appropriate model for non-clinical studies evaluating the treatment of achondroplasia.

Rationale for Dose Level and Interval Selection

Figure 10:
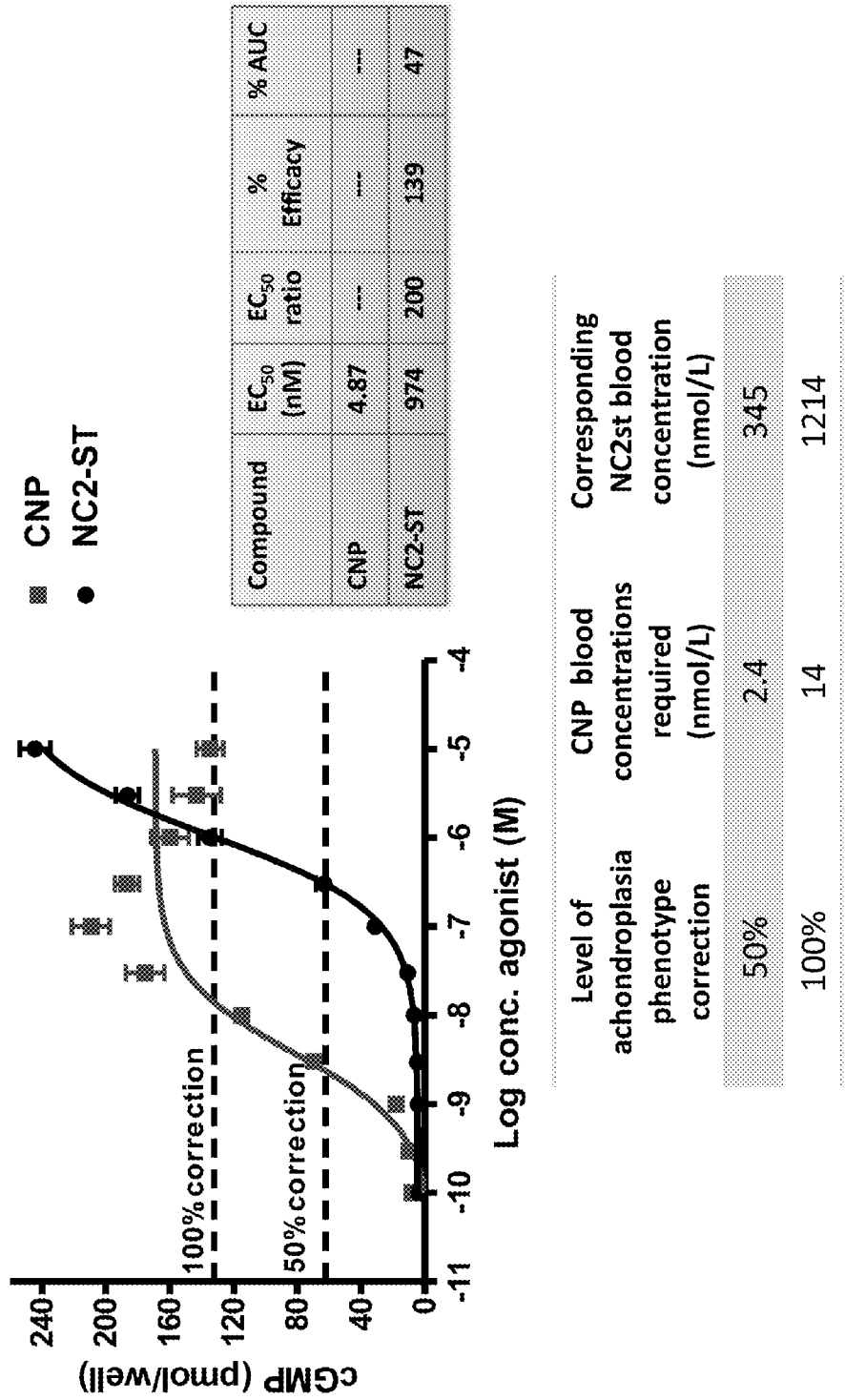
FIG. 10 is a graph showing the averaged results of 15 NPR-B whole cell dose-response assays for CNP and NC2st, together with a table showing average values for $EC_{50}$, $EC_{50}$ ratio relative to CNP, % efficacy, and % AUC. Also shown is a table showing levels of CNP required to achieve 50% and 100% achondroplasia phenotype correction (see, e.g., Yasoda et al., *Endocrinology* 150:3138-3144, 2009, hereby incorporated by reference), and projected corresponding levels of NC2st blood concentrations expected to achieve 50% and 100% achondroplasia phenotype correction.
Figure 11:
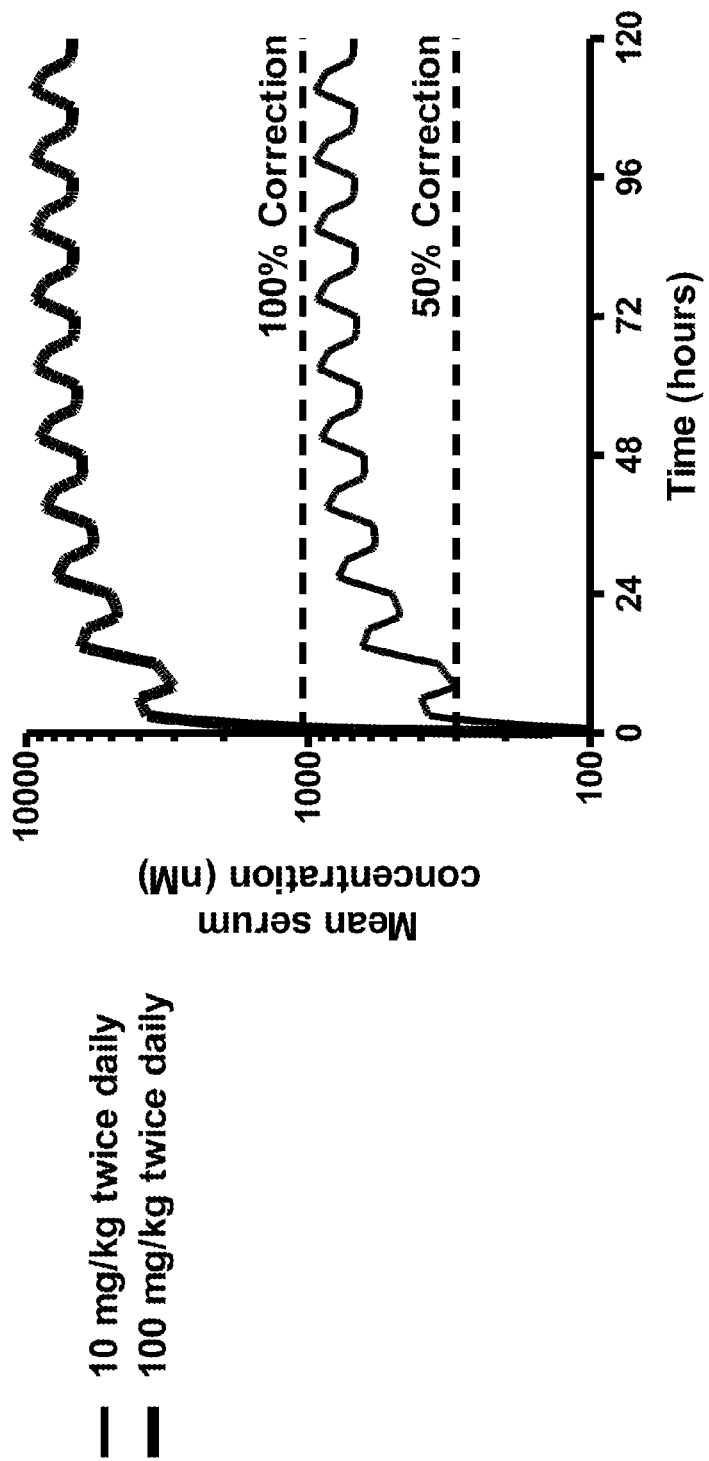
FIG. 11 is a graph showing a dose regimen simulation for NC2st for two doses: 10 mg/kg twice daily, and 100 mg/kg twice daily.
Figure 12A:
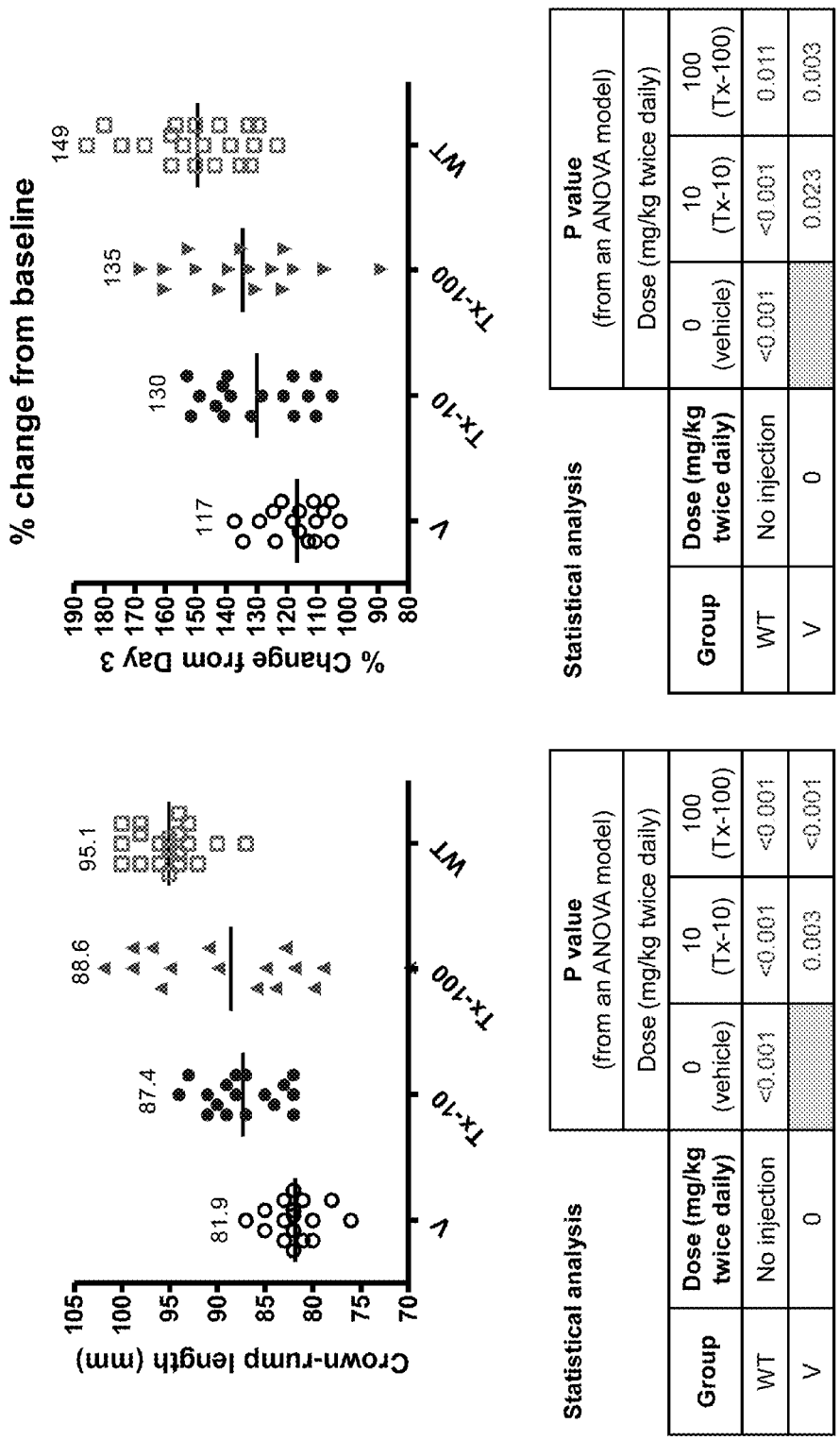
Figure 12B:
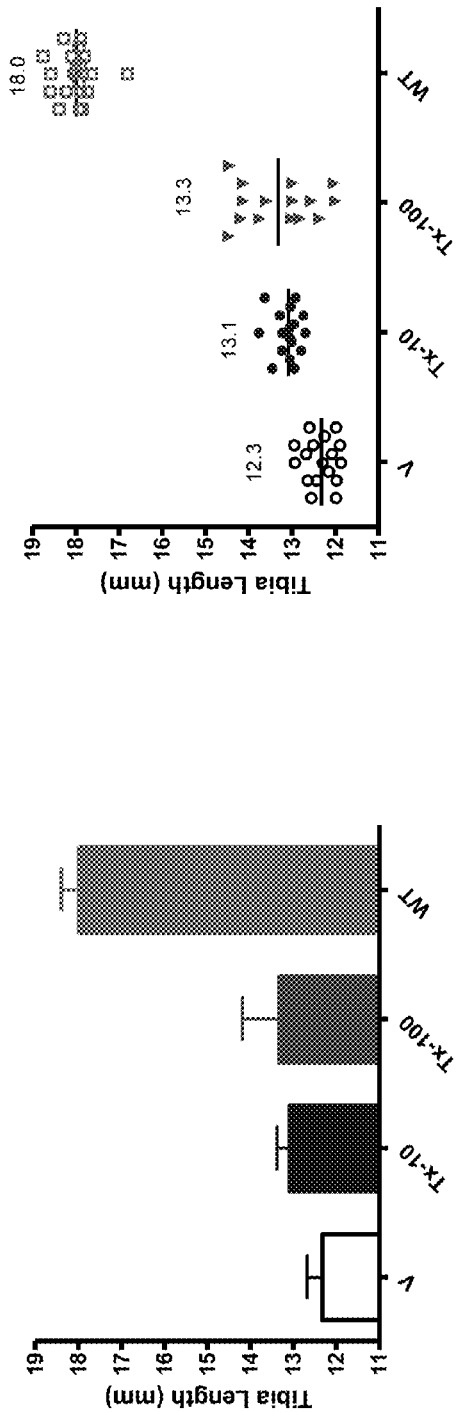
Figure 12C:
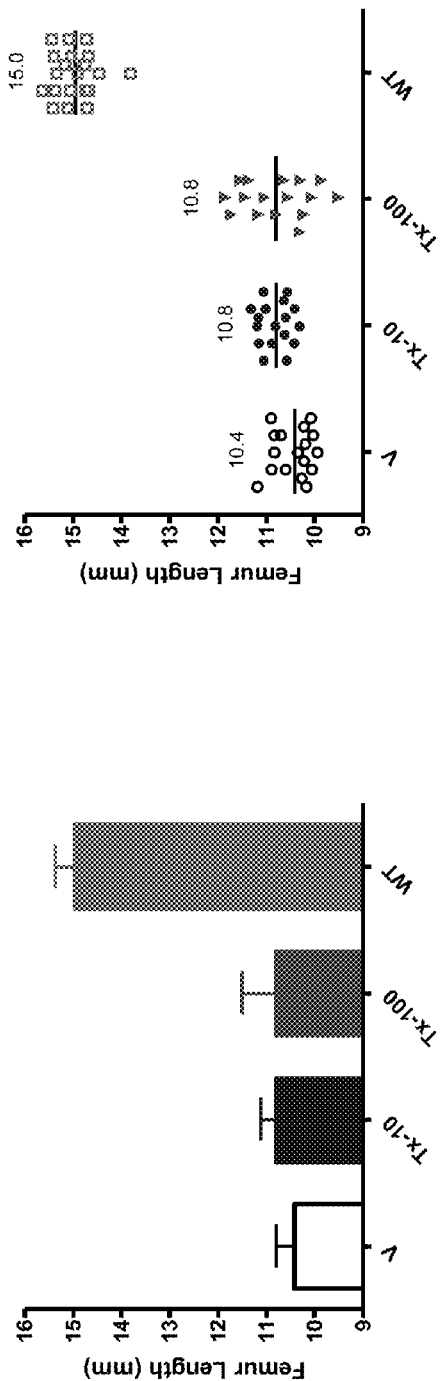
Figure 12D:
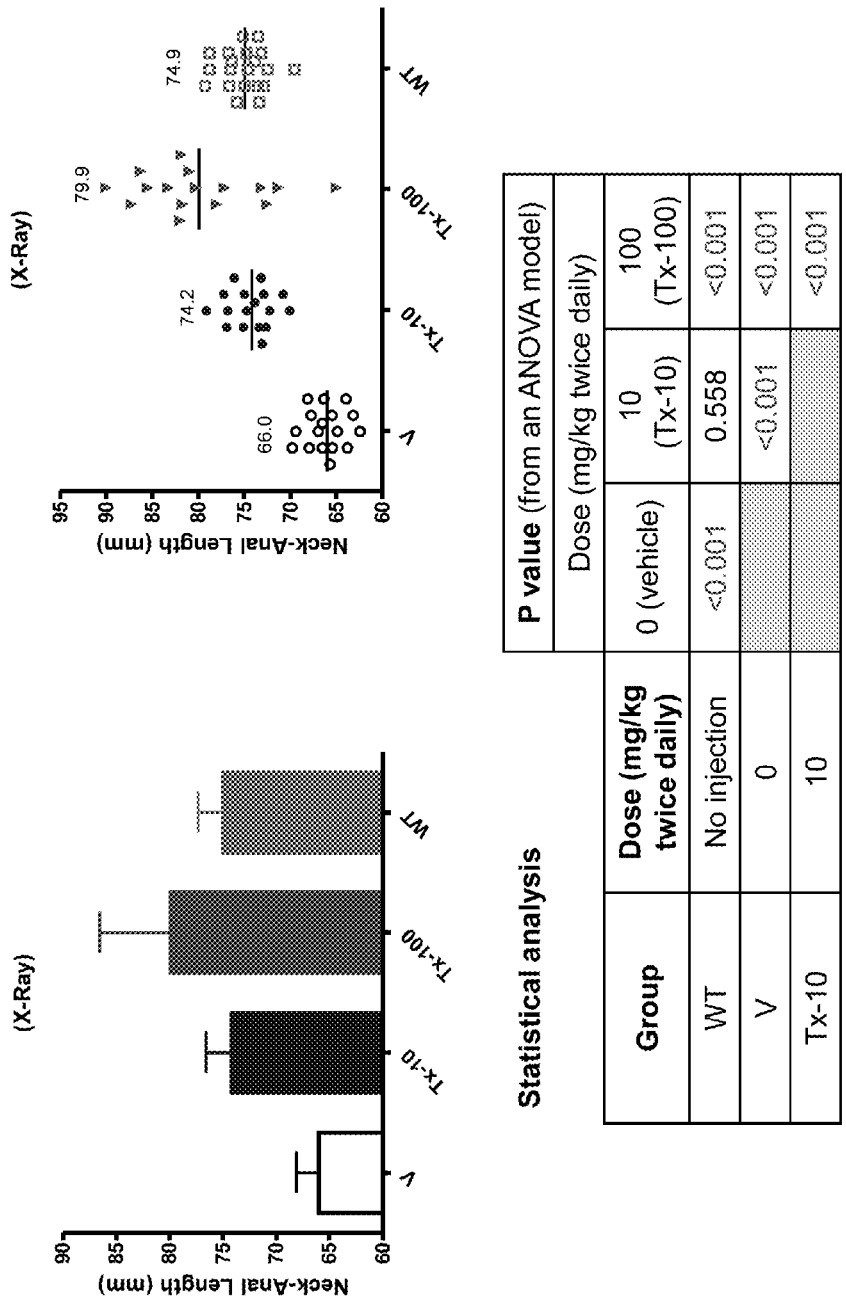
Figure 12F:
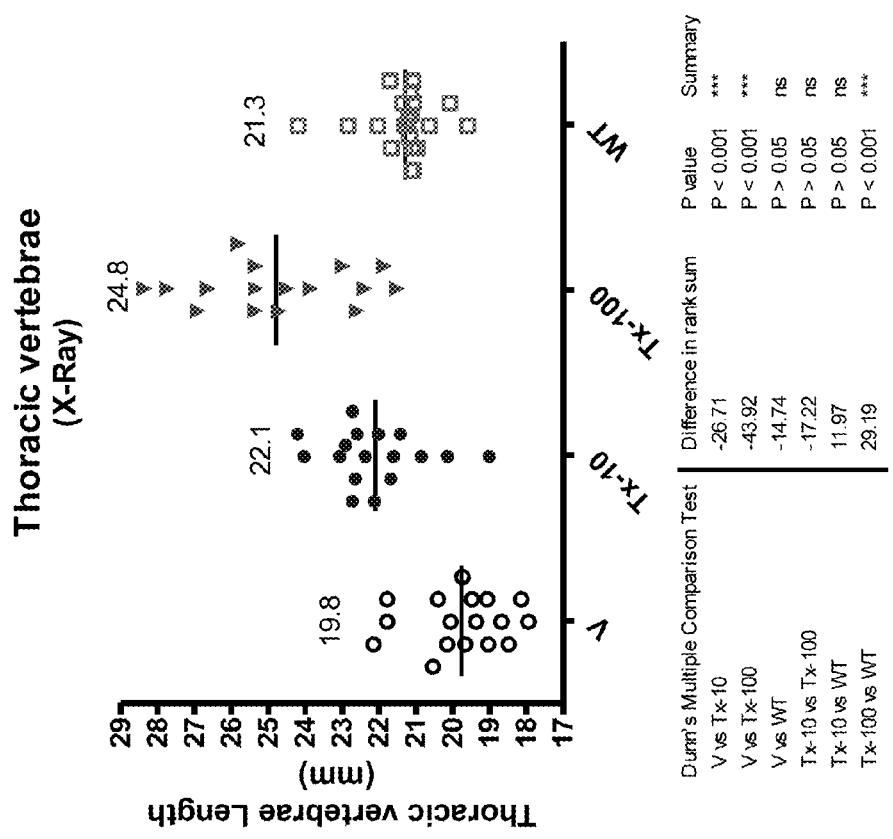
Figure 12G:
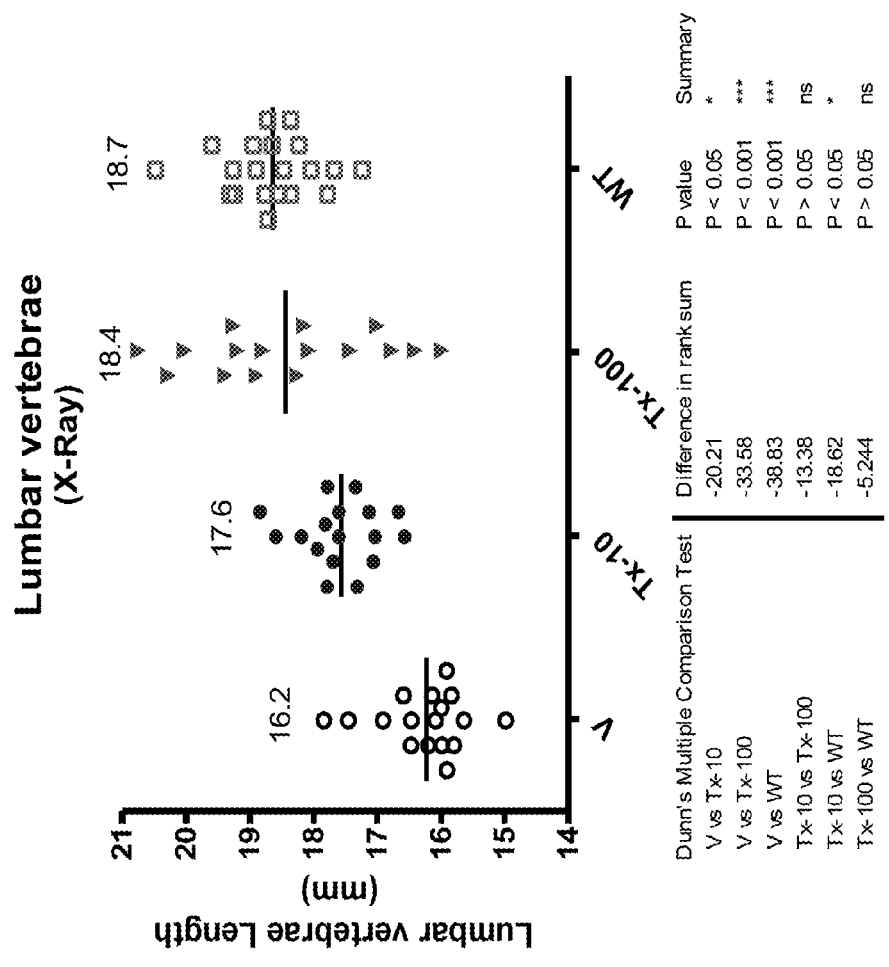

Based on the relative biological activities of CNP22 and NC2st, as determined in a set of NPR-B whole cell dose-response assays (FIG. 10), it was projected that the targeted NC2st concentrations to achieve 50 and >100% reversal of ACH phenotype would be 345 (±95 S.D.) and 1214 (±446 S.D.) nM, respectively. Based on WinNonlin simulation of NC2st pharmacokinetic data obtained from a single dose pharmacokinetic study in adult mice (FIG. 11), a dose of 10 mg/kg given SC twice daily would achieve >50% reversal. 100 mg/kg twice daily would be sufficient to achieve more than 100% reversal.

Experimental Design

The study was an open label parallel and randomized control study. Treatments were open label, and Table 5 provides details of the treatment groups.

Experimental Procedures

Mortality checks were performed each day and noted in study books. The animals were examined each day. If present, clinical signs were noted in study books.

At necropsy (Day 64), blood samples were collected by cardiac puncture under isoflurane anesthesia 13-18 hours after the last dose. Blood samples were collected into Microvette 500Z/gel tube (Sarstedt, serum/gel clotting activator, #20.1344), incubated at room temperature for 30 to 60 minutes and centrifuged at 10,000×g for five minutes at 2-8° C. 100 μl of serum was then transferred into 0.5 mL tubes (Sarstedt, #72.699), and the remainder was transferred in a second tube. The two tubes were frozen in liquid nitrogen and stored at −80° C. until analysis.

TABLE 5

| Group No. | Group description | ROA | Duration of treatment* | Dosing Interval | Dose Level (mg/kg) | Conc. (mg/mL) | $Fgfr3^{369/+}$ (male & female) N = | WT (male & female) N = |
|---|---|---|---|---|---|---|---|---|
| 1 | V | SC injection | 61 | Twice daily | 0 | 0 | 15 | 0 |
| 2 | Tx-10 | SC injection | 61 | Twice daily | 10 | 2.5 | 15 | 0 |
| 3 | Tx-100 | SC injection | 61 | Twice daily | 100 | 25 | 15 | 0 |
| 4 | WT | — | — | — | — | — | 0 | 15 |

WT (wild-type): normal littermate of $Fgfr3^{369/+}$ mice
—: not injected
ROA: route of administration
*The duration of treatment was 61 days, as animals were treated from 3 to 63 days of age. The study duration was 64 days, including necropsy on day 64.

Injections were scheduled twice daily at approximately 8:00 to 10:00 AM and 8:00 to 10:00 PM. The dose volume was set at 4 ml/kg. The actual volume administered to each mouse was calculated and adjusted based on the daily body weight of each animal measured prior to the AM injection. Vehicle or NC2st was injected SC twice daily into the scapular or lumbar region of $Fgfr3^{369/+}$ animals from the third day after birth to 63 days of age.

A summary of the study endpoints is shown in Table 6.

TABLE 6

| Endpoints | Day 3 → Day 63 | Occasions Day 3, 10, 17, 24, 31, 38, 45, 52, 59 | Necropsy Day 64 |
|---|---|---|---|
| Body weight | √ | | √ |
| Crown/Rump length | | √ | √ |
| Tail length | | √[a] | √ |
| Bone length: tibia and femur | | | √ |
| Test article concentration in serum | | | √ |
| Test article biological activity in serum | | | √ |
| Whole body X-Ray | | | |
| Naso-Anal length | | | √ |
| Neck-Anal length | | | √ |
| Cervical-Thoracic-Lumbar length | | | √ |
| Sternum length | | | √ |
| Skull morphology | | | √ |

[a]on Day 31, 38, 45, 52 and 59

The animals were euthanized by a bilateral thoracotomy under isoflurane anesthesia and a gross pathology check was performed. All gross pathology check findings were reported in study books.

The concentration and biological activity of NC2st in serum samples was assessed using a CNP22 fluorescent EIA kit (Phoenix Pharmaceuticals, cat# FEK-012-03) and a cyclic-GMP fluorescent assay kit (Molecular Devices, cat# R8075), respectively.

Ex vivo radiographs of whole body, rib cage and skull were taken using a Faxitron model MX-20 DC4 under constant conditions (26 kV, 10 sec at 1×, 3× and 3× magnification, respectively). Bone measurements were performed on the radiographic images of all animals in a blinded fashion using the software Image Processing and Analysis in Java (ImageJ).

Bone samples were cleaned of excess tissue (not scraped) and fixed. Length of femur and tibia was measured using a caliper.

Results

Experimental results are shown in FIGS. 12A-12H and are summarized in Table 7 below.

TABLE 7

| Length measurement | Tx-10 % change vs Vehicle | Tx-100 % change vs Vehicle |
|---|---|---|
| Tibia | +6.50%* | +8.13%* |
| Femur | +3.85%* | +3.85%* |
| Naso-anal | +8.99%* | +14.3%* |
| Neck-anal | +12.4%* | +21.1%* |
| Total $CTL^a$ vertebrae | +11.6%* | +20.9%* |
| Cervical vertebrae | +17.6%* | +24.3%* |
| Thoracic vertebrae | +11.6%* | +25.3%* |

TABLE 7-continued

| Length measurement | Tx-10<br>% change vs Vehicle | Tx-100<br>% change vs Vehicle |
|---|---|---|
| Lumbar vertebrae | +8.64%* | +13.6%* |
| Sternum | +6.67%* | +13.7%* |
| Tail | +7.38%* | +7.22%* |
| Occipital-front distance | +0.89% | +0.76% |
| Skull Circularity index | −1.52% | −2.88%* |

[a]Cervical, thoracic, lumbar
*Significant, P < 0.05

Figure 13:
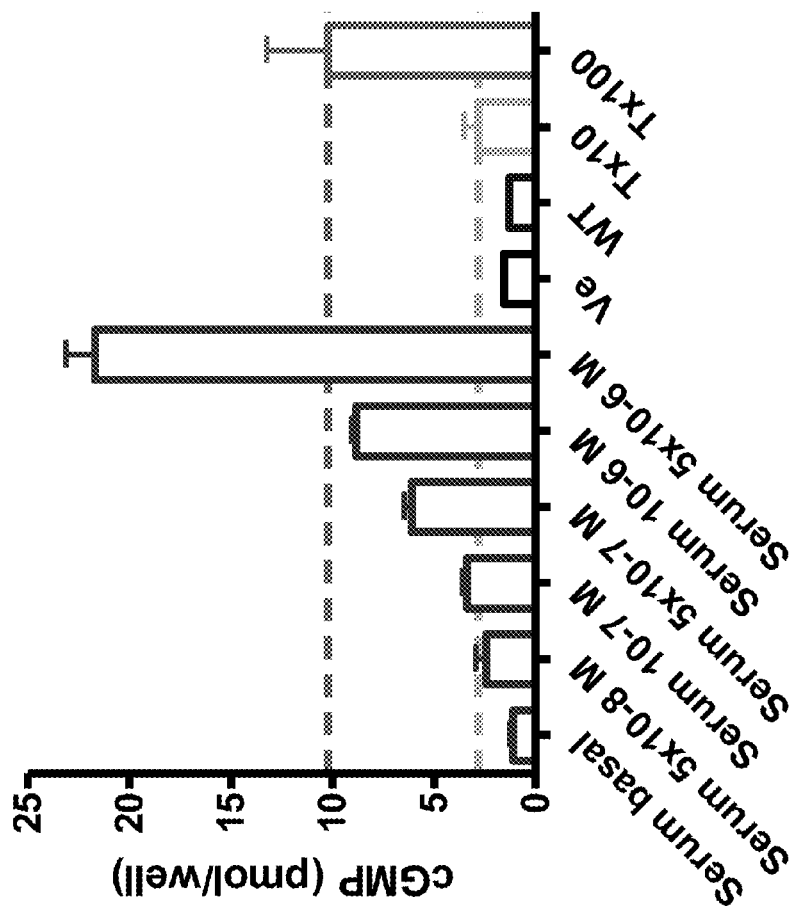
FIG. 13 is a chart showing correlation between results of cGMP assays using serum spiked with NC2st (left) and serum from vehicle (Ve), wild-type (WT), Tx10 dosed mice, and Tx100 dosed mice (right).
Figure 14:
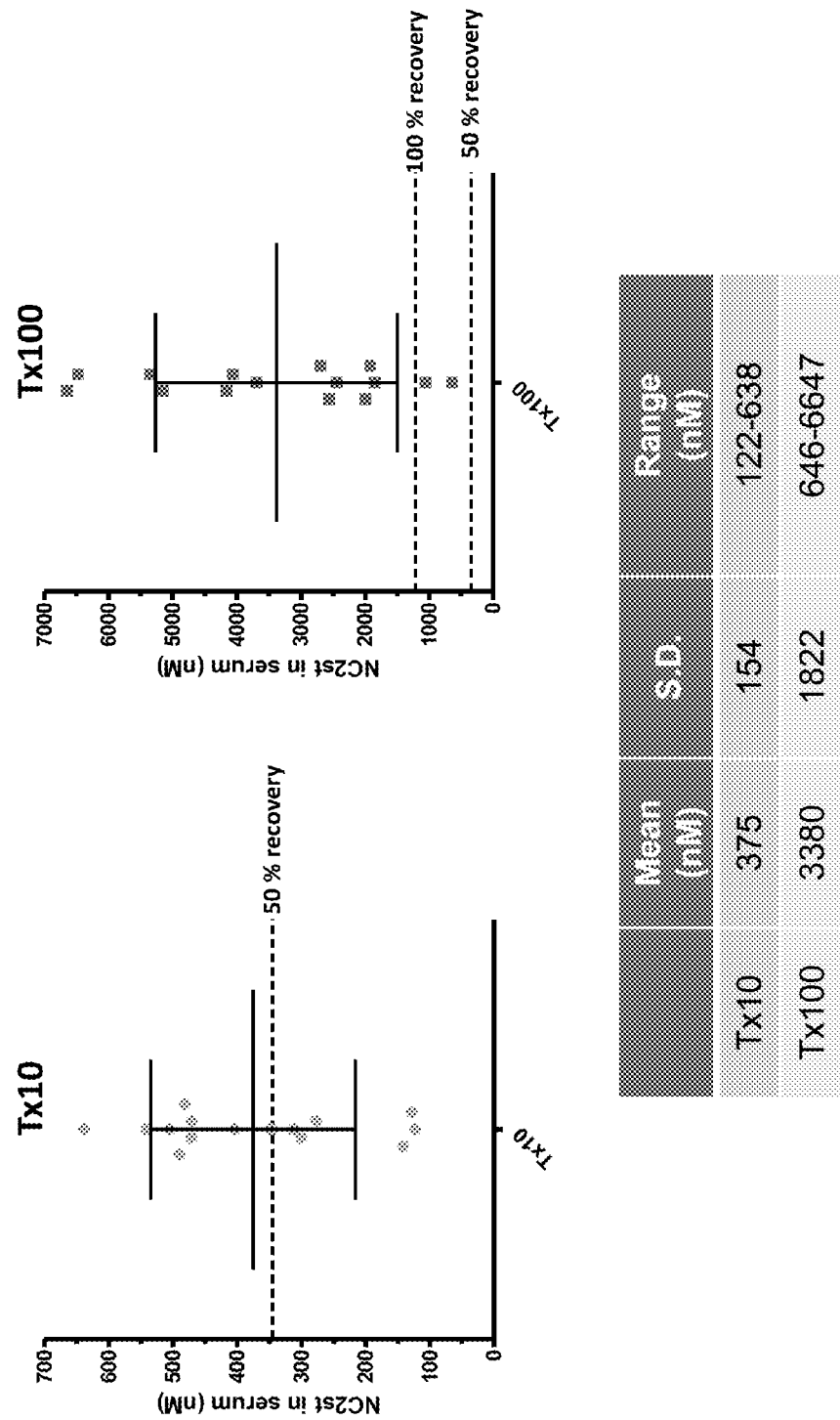
FIG. 14 is a pair of charts showing the active concentrations of NC2st present in blood samples of mice in the Tx10 group (left) and Tx100 group (right).

In addition, FIG. 13 shows the results of cGMP assays using serum spiked with NC2st (left) and serum from vehicle (Ve), wild-type (WT), Tx-10 dosed (Tx10) mice, and Tx-100 dosed (Tx100) mice (right), in order to be able to determine active concentrations of NC2st present in blood samples using a cGMP assay as described above. The charts and table in FIG. 14 show the active concentrations of NC2st present in blood samples of mice in the Tx10 group (left) and Tx100 group (right), demonstrating that the mean NC2st blood serum level in the Tx10 group was above the projected threshold for 50% reversal of the ACH phenotype, while the mean NC2st blood serum level in the Tx100 group was nearly three-fold above the projected threshold for 100% reversal of the achondroplasia phenotype.

Taken together, these results demonstrate that an Fc-NP fusion, such as NC2st, is capable of reversing the achondroplasia phenotype in a severe mouse model of the disease.

Example 6

Modification of NC2st

Figure 17:
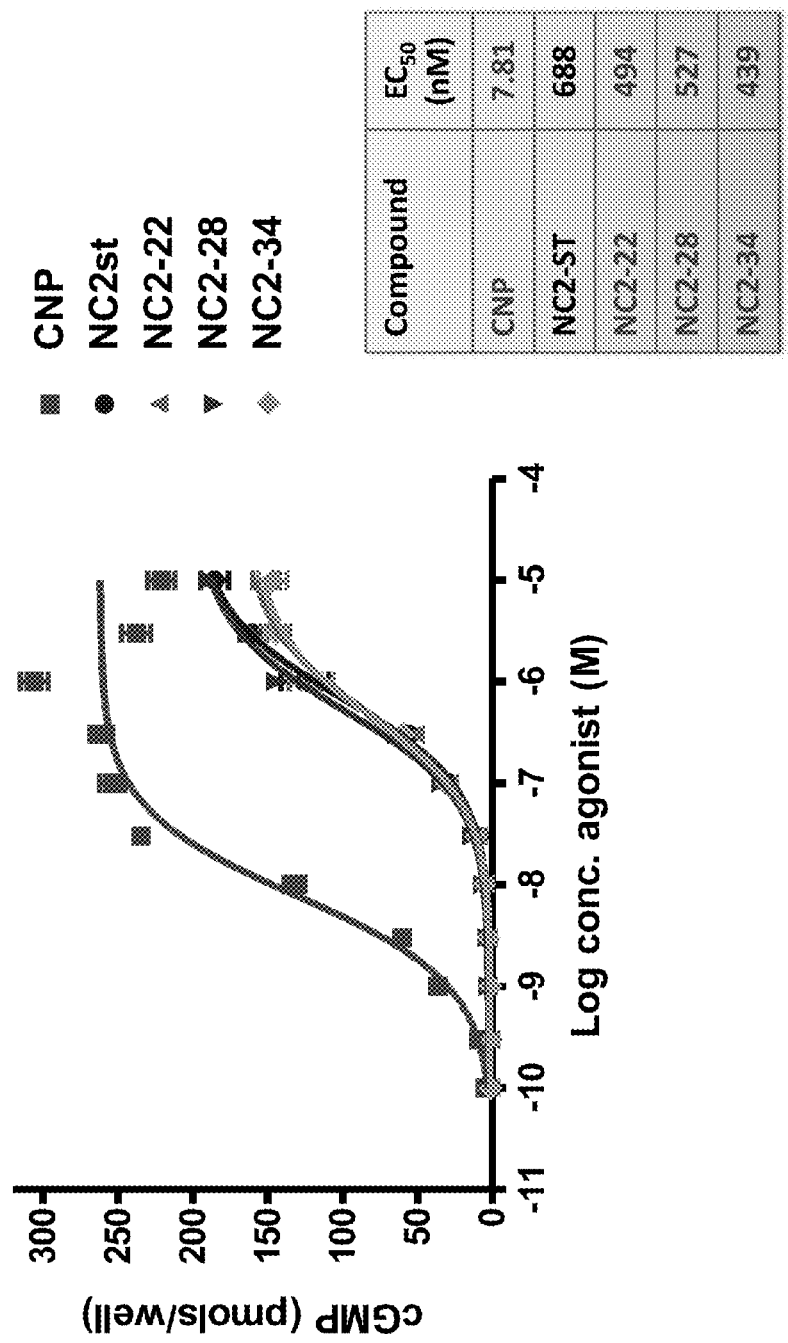
FIG. 17 is a graph showing the results of an NPR-B whole cell dose-response assay for CNP, NC2st, NC2B-22, NC2B-28, and NC2B-34, together with a table showing $EC_{50}$ values.

NC2st may be varied in several respects, including elimination of the sequence that is N-terminal to the Fc domain (resulting, e.g., in NC2B, as shown in FIGS. 15A-15B), addition of a bone-targeting moiety (resulting, e.g., in D10-NC2, as shown in FIG. 15A), and alteration of the length of the linker between Fc and CNP22 (e.g., NC2B-22 (also referred to as $NC_{2-22}$), NC2B-28 (also referred to as $NC_{2-28}$), and NC2B-34 (also referred to as $NC_{2-34}$), as shown in FIGS. 16A-16D). In one set of experiments, NC2st, NC2B-22, NC2B-28, and NC2B-34 were tested in an NPR-B dose-response whole cell assay. The results of this experiment are shown in FIG. 17. Other exemplary NC2st variants are shown in FIG. 18 (NC2-KGANKK and NC2-KGANQK) and FIG. 19 (NC2-CNP53mut2).

Example 7

Fc-CNP53 Constructs

In this set of experiments, two constructs were prepared in which an N-terminal Fc domain is fused to a variant of CNP53 with a short $Gly_3$ linker region. An alternative way to analyze these fusion polypeptides is that the linker region is $Gly_3$ followed by amino acids 1-31 of CNP53 (or variants thereof); viewed in this way, the linker region connects the Fc domain to CNP22 and is 34 amino acids in length.

For Fc-CNP53-A (also referred to as "Fc-CNP53 wt") (SEQ ID NOs: 517 (with signal sequence) and 518 (without signal sequence); FIG. 20), position 48 of CNP53, corresponding to position 17 of CNP22, was mutated to alanine. Fc-CNP53-AAA (also referred to as "Fc-CNP53mut") (SEQ ID NOs: 519 (with signal sequence) and 520 (without signal sequence); FIG. 20) has the same sequence as Fc-CNP53-A with the exception that residues 30 and 31 of CNP53, the two residues immediately before CNP22, are mutated to alanine in order to reduce the likelihood of proteolytic cleavage. These two constructs were tested, along with NC2st, in two NPR-B membrane assays and one NPR-B whole cell assay.

Figure 21A:
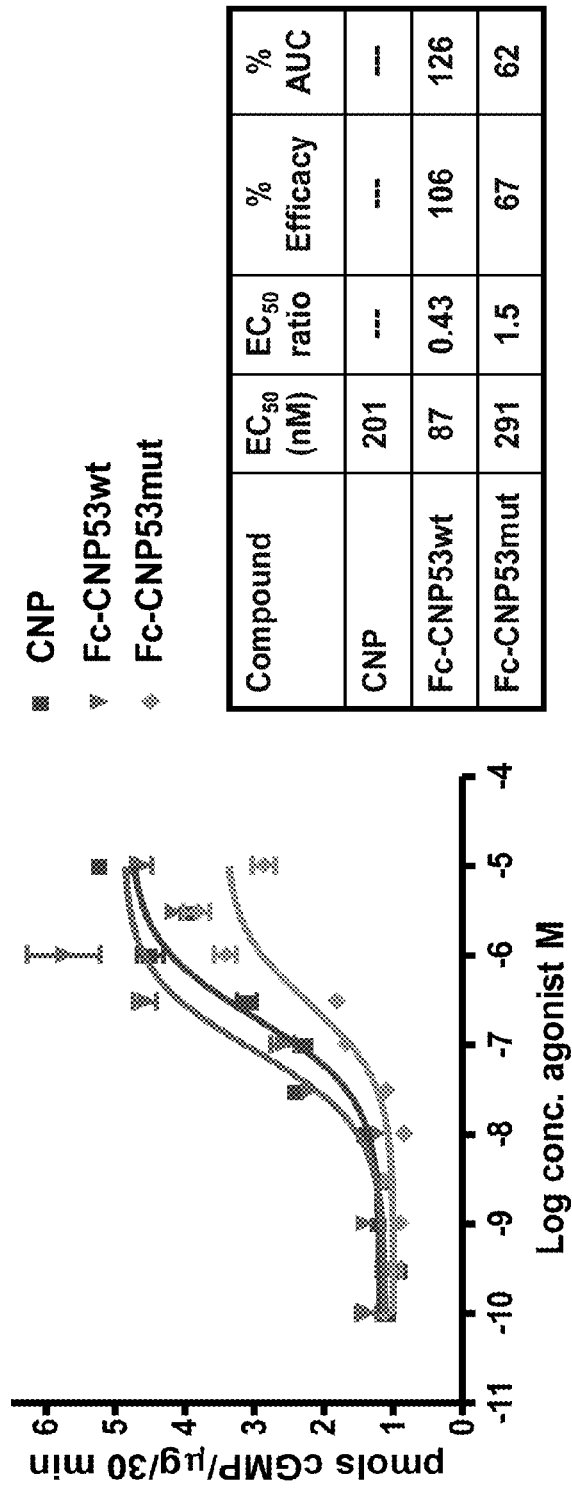
FIG. 21A is a set of dose-response curves for CNP, Fc-CNP53-A (also referred to as Fc-CNP53 wt), and Fc-CNP53-AAA (also referred to as Fc-CNP53mut) in an NPR-B membrane assay, together with a table showing $EC_{50}$ values, $EC_{50}$ ratios relative to CNP, % efficacy, and % AUC.
Figure 21B:
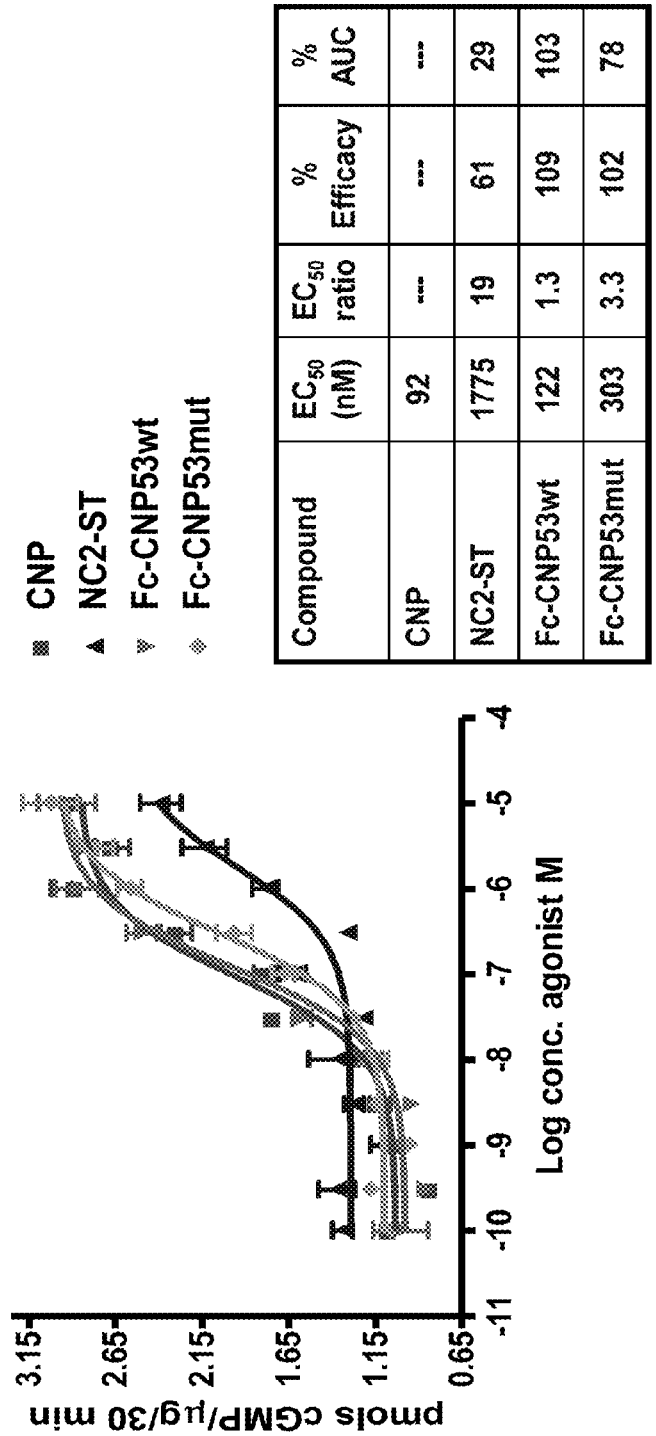
FIG. 21B is a set of dose-response curves for CNP, NC2st, Fc-CNP53-A, and Fc-CNP53-AAA in an NPR-B membrane assay, together with a table showing $EC_{50}$ values, $EC_{50}$ ratios relative to CNP, % efficacy, and % AUC.

In the first membrane assay, Fc-CNP53-A demonstrated more than twice the potency as CNP and slightly better efficacy than CNP, while Fc-CNP53-AAA had a potency of 1.5 times less than that of CNP, and about two-thirds of CNP's efficacy (FIG. 21A). In the second membrane assay, Fc-CNP53-A had a potency of 1.3 times less than that of CNP and comparable efficacy, while Fc-CNP53-AAA had a potency of 3.3 times less than that of CNP and comparable efficacy. The potency of NC2st in the second assay was 19 times less than that of CNP, while the efficacy was 61% that of CNP (FIG. 21B).

Figure 21C:
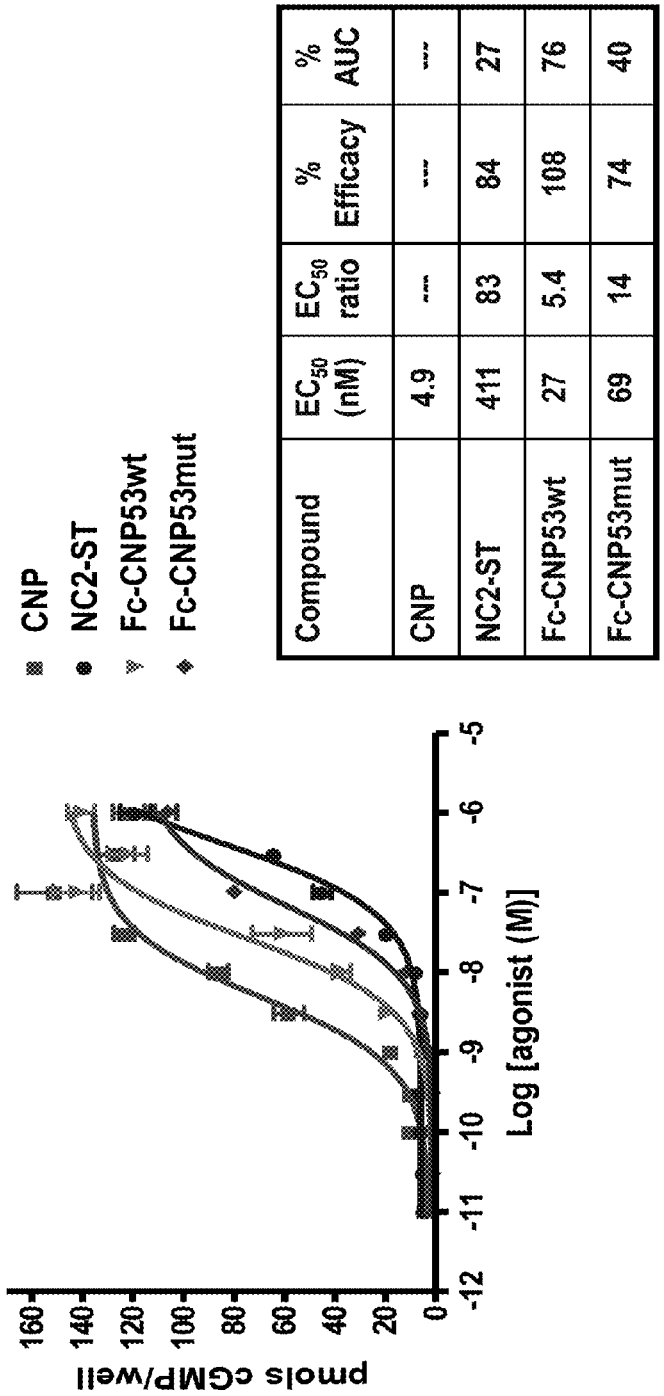
FIG. 21C is a set of dose-response curves for CNP, NC2st, Fc-CNP53-A, and Fc-CNP53-AAA in an NPR-B whole cell assay, together with a table showing $EC_{50}$ values, $EC_{50}$ ratios relative to CNP, % efficacy, and % AUC.

In the whole cell assay, Fc-CNP53-A had a potency of 5.4 times less than that of CNP and comparable efficacy, while Fc-CNP53-AAA had a potency of 14 times less than that of CNP and 74% efficacy. The potency of NC2st was 83 times less than that of CNP, while the efficacy was 84% that of CNP (FIG. 21C).

Taken together, these results show that modifying the linker region of an Fc-CNP22 fusion to include the first 31 amino acids of CNP53 results in constructs having even greater potency and efficacy than NC2st in in vitro membrane and whole cell assays.

Example 8

CDNP Variants

CDNP (SEQ ID NO: 100; FIG. 22) is a hybrid NP consisting of CNP22 fused to the C-terminal tail of DNP. This NP agonizes NPR-B but has significant cross-reactivity with NPR-A. In order to increase the selectivity of CDNP for NPR-B, mutations were made in several of the tail residues of CDNP.

In the first set of CDNP experiments, several CDNP variants were tested to evaluate their sensitivity to NEP degradation. The variants tested were CDNP-N1 (SEQ ID NO: 101), CDNP-G1 (SEQ ID NO: 102), CDNP-H1 (SEQ ID NO: 103), and CDNP-K1 (SEQ ID NO: 104), as shown in FIG. 22 (numbers refer to the position of the mutation relative to the DNP tail (SEQ ID NO: 117)), with CDNP and CNP22 included as controls. For the NEP degradation assays, 125 µM of peptide was incubated at 37° C. in 500 µL total of buffer (100 mM Tris-Cl, pH 7.5, 100 mM NaCl) containing 1.25 ng/µL of purified neutral endopeptidase (Innovative research). At times 0 minutes, 10 minutes, 30 minutes, 60 minutes, 120 minutes, and 240 minutes, 70 µL was taken from the tubes and heat inactivated at 100° C. for 10 minutes on a dry heat block. Aliquots were then put on ice or stored at −20° C. After centrifugation at 20,000×g for 5 minutes, 65 µL of the supernatant was transferred to HPLC tubes for 2×20 µL injections into reverse phase HPLC for analysis (Agilent XDB-C18).

Figure 23:
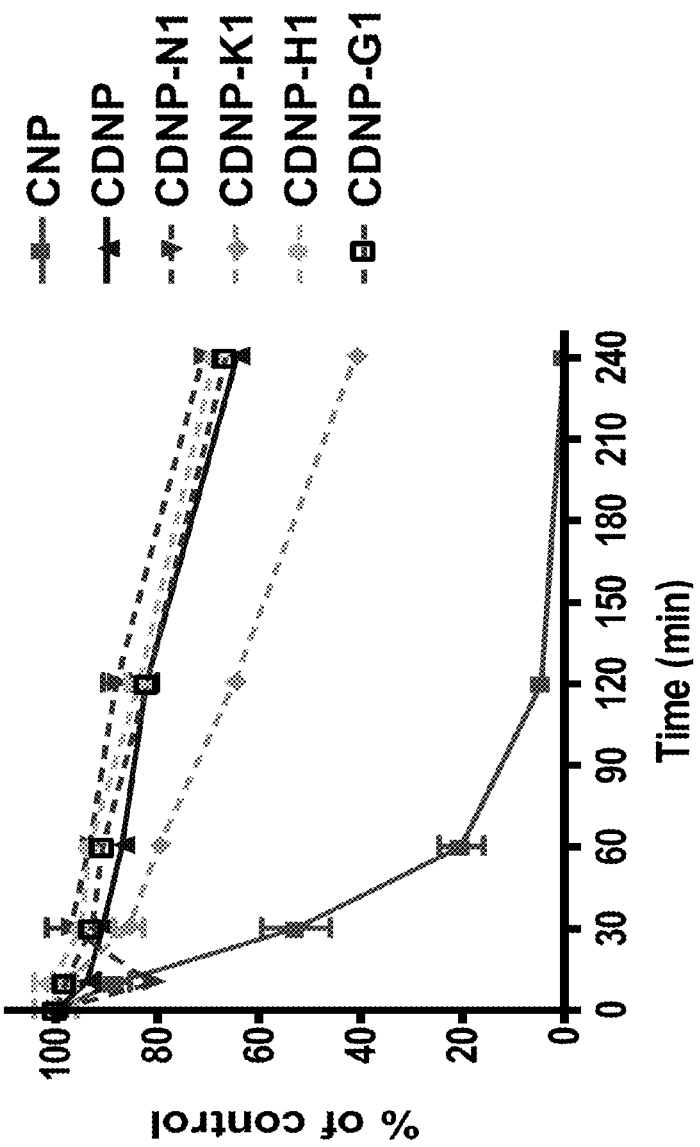
FIG. 23 is a graph showing the results of NEP degradation assays for CNP, CDNP, CDNP-N1, CDNP-K1, CDNP-H1, and CDNP-G1.
Figure 24A:
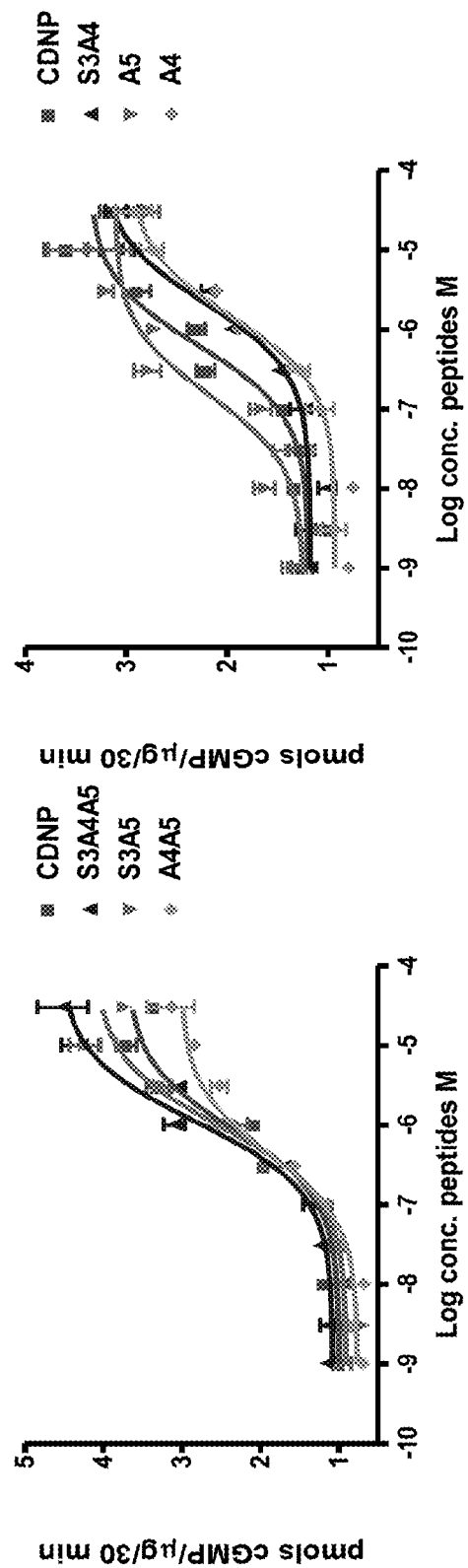
FIG. 24A is a set of dose-response curves for CDNP and several variants (CDNP-A4, CDNP-A5, CDNP-S3A4, CDNP-A4A5, CDNP-S3A5, and CDNP-S3A4A5) as tested in an NPR-B membrane assay.
Figure 24B:
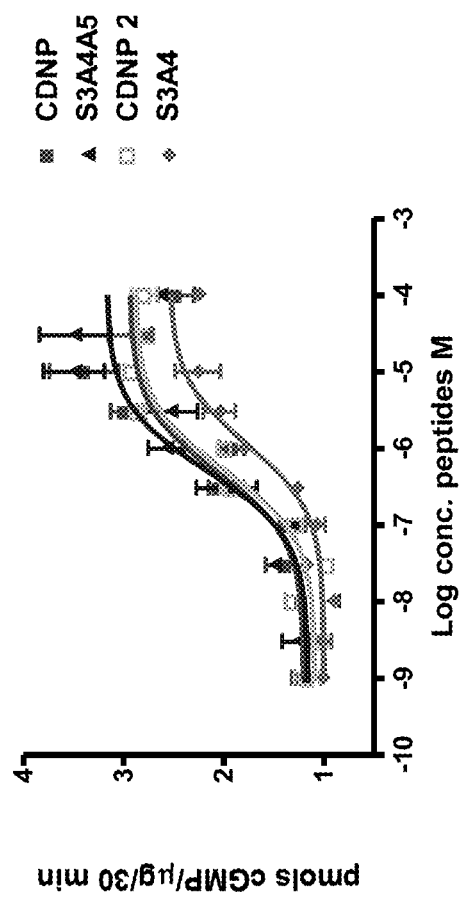
FIG. 24B is an additional set of dose-response curves for CDNP (tested twice), CDNP-S3A4, and CDNP-S3A4A5 as tested in an NPR-B membrane assay.
Figure 24C:
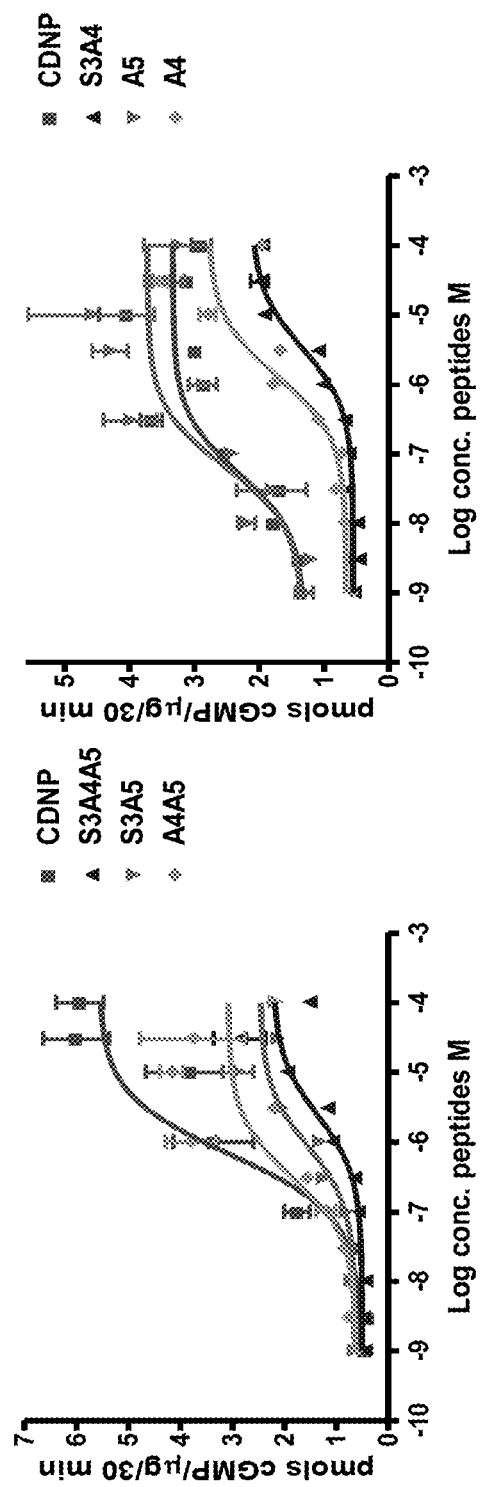
FIG. 24C is a set of dose-response curves for CDNP and several variants (CDNP-A4, CDNP-A5, CDNP-S3A4, CDNP-A4A5, CDNP-S3A5, and CDNP-S3A4A5) as tested in an NPR-A membrane assay.
Figure 24D:
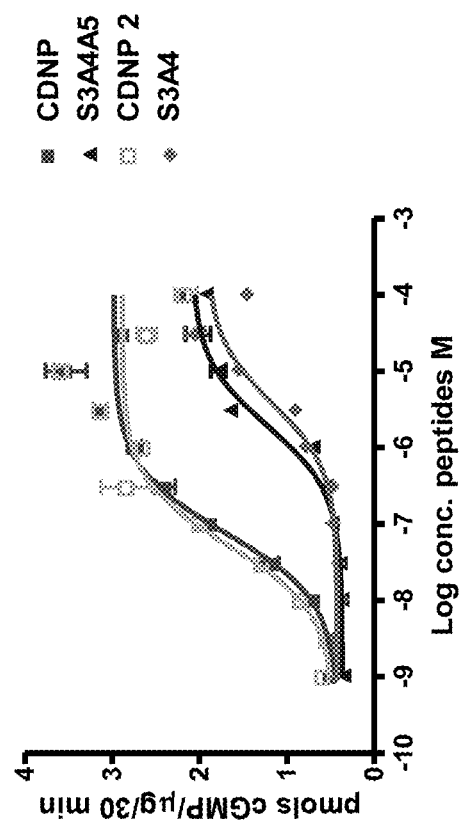
FIG. 24D is an additional set of dose-response curves for CDNP (tested twice), CDNP-S3A4, and CDNP-S3A4A5 as tested in an NPR-A membrane assay.

Each of the tested variants exhibited significantly decreased sensitivity (i.e., increased resistance) to NEP in comparison to CNP22, with CDNP, CDNP-N1, CDNP-G1, and CDNP-H1 all having comparable NEP sensitivity. CDNP-K1 was slightly more sensitive to NEP than the other CDNP variants but was still much less sensitive than CNP22. Results are shown in FIG. 23. This demonstrates that CDNP, which is substantially more resistant to NEP degradation than CNP22 alone, may be altered without substantial loss of NEP resistance.

Example 9

CDNP Variants at Tail Positions 3, 4, and 5

As shown in FIG. 22, residues 3-5 of the C-terminal extension following the 17-amino acid ring show a significant degree of conservation across natriuretic peptide type and species, and thus these residues may play an important role in NPR-A agonist activity. Mutating one or more of these residues could result in decreased NPR-A agonist activity without significantly impairing NPR-B agonist activity, as CNP22 lacks a C-terminal tail altogether.

In this set of experiments, mutations were introduced at positions 3, 4, and/or 5 of the DNP tail in order to identify CDNP variants having improved selectivity for NPR-B. The following CDNP variants were tested: CDNP-A4 (SEQ ID NO: 107); CDNP-A5 (SEQ ID NO: 108); CDNP-S3A4 (SEQ ID NO: 109); CDNP-A4A5 (SEQ ID NO: 110); CDNP-S3A5 (SEQ ID NO: 111); and CDNP-S3A4A5 (SEQ ID NO: 113). Results are shown in FIGS. 24A-24D and in Tables 8-10 below. The experiments are performed under identical conditions. The membrane potency assay is quick and convenient and allows comparison of peptides with CNP or CDNP in the same experiment.

TABLE 8

Whole Cell cGMP Assay

| Peptide | $EC_{50}$ on NPR-B (nM) | $EC_{50}$ on NPR-A (nM) |
|---|---|---|
| CNP | 4.87 | ND |
| ANP | ND | 1.4 |
| CDNP | 25 | 73 |

TABLE 9

Membrane cGMP Assay Potency

| Peptide | $EC_{50}$ ratio versus CDNP on NPR-B (nM) | $EC_{50}$ ratio versus CDNP on NPR-A (nM) | Approximate fold gain in selectivity versus CDNP (column C/column B) | Approximate fold selectivity NPR-B versus NPR-A |
|---|---|---|---|---|
| CDNP-SAA | 1.24-1.03 | 3.63-30.1 | 14.9 | 43.5 |
| CDNP-SRA | 1.08 | 1.33 | 1.23 | 3.59 |
| CDNP-LAA | 0.49 | 0.48 | 0.98 | 2.86 |
| CDNP-SAD | 3.45-2.32 | 105-59.7 | 28.5 | 83.2 |
| CDNP-LRA | 0.24 | 1.33 | 5.54 | 16.2 |
| CDNP-LAD | 2.31 | 41.1 | 17.8 | 52.0 |

TABLE 10

Membrane cGMP Assay Efficacy

| Peptide | % efficacy versus CDNP on NPR-B | % efficacy versus CDNP on NPR-A | % loss in efficacy versus CDNP |
|---|---|---|---|
| CDNP-SAA | 128-114 | 34-69 | 69 |
| CDNP-SRA | 118 | 36 | 82 |
| CDNP-LAA | 85 | 49 | 36 |
| CDNP-SAD | 91-87 | 65-59 | 27 |
| CDNP-LRA | 87 | 114 | -27 |
| CDNP-LAD | 92 | 90 | 2 |

As the Tables above show, CDNP activated NPR-B with an $EC_{50}$ value of 25 nM, whereas it activated NPR-A with an $EC_{50}$ value of 73 nM (3-fold more selective towards NPR-B).

C12 (CDNP-SAD) was ~83-fold more selective towards NPR-B, 28-fold gain in selectivity compared to CDNP. NPR-B selective efficacy gain was 27%.

C11 (CDNP-SRA) was ~3.6-fold more selective towards NPR-B, 1.2-fold gain in selectivity compared to CDNP. NPR-B selective efficacy gain was 82%.

C10 (CDNP-SAA) was ~45-fold more selective towards NPR-B, 15-fold gain in selectivity compared to CDNP. NPR-B selective efficacy gain was 69%.

Figure 25:
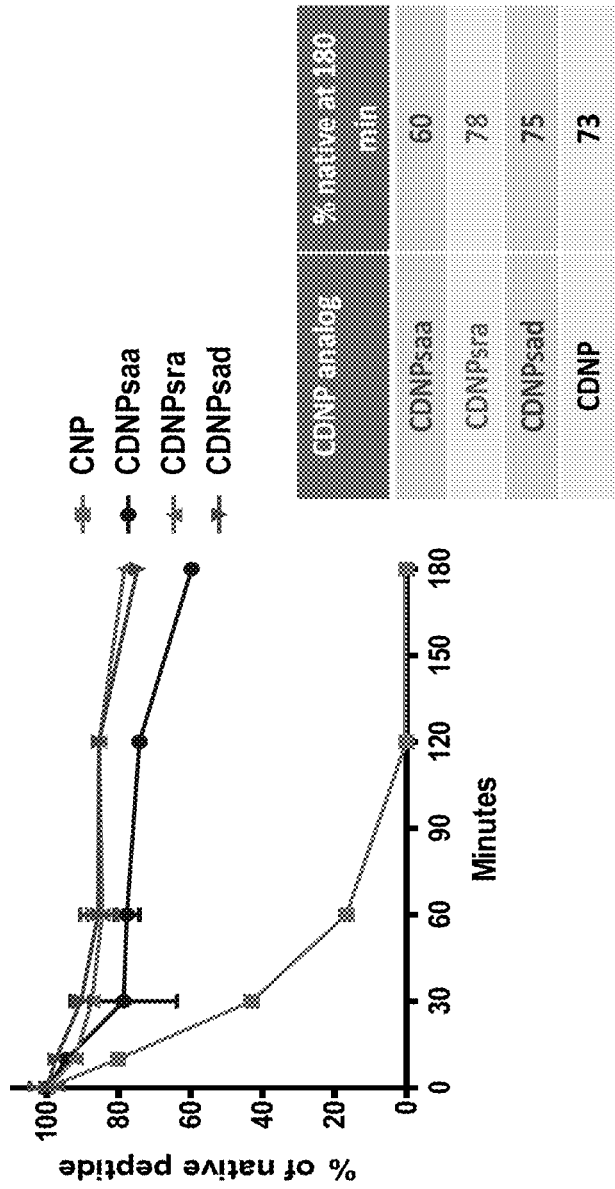
FIG. 25 is a graph showing the results of NEP degradation assays for CNP and three variants (CDNP-S3A4A5 (CDNP-saa), CDNP-S3A5 (CDNPsra), and CDNP-S3A4 (CDNP-sad)), together with a table showing the percent of intact molecule remaining after 180 minutes.

In addition, CDNP-S3A4, CDNP-S3A5, and CDNP-S3A4A5 were tested to evaluate their sensitivity to NEP degradation, with CDNP and CNP22 included as controls. As shown in FIG. 25, CDNP-S3A4 (CDNPsad) and CDNP-S3A5 (CDNPsra) have comparable NEP sensitivity, while CDNP-S3A4A5 (CDNPsad) is slightly more sensitive to NEP than CDNP. All variants tested were much less sensitive to NEP than CNP22.

In summary, these results demonstrate that the NPR-B/NPR-A selectivity of CDNP can be increased, for example, by mutating the LRD residues at positions 3-5 of the C-terminal tail of CDNP. The S3A4 mutation had the most drastic effect on potency, whereas the S3A5 mutation had the most significant effect on efficacy. In addition, modification of these residues in CDNP did not significantly increase their sensitivity to NEP degradation.

Example 10

NP-Fc Fusions

Fusion polypeptides having an N-terminal NP domain and a C-terminal Fc domain may be constructed. Several examples are shown in FIG. 26A and include CNP-16AAlinker-Fc-His$_{10}$ (NC1) (SEQ ID NO: 521); CNP-6AAlinker-Fc-His$_{10}$ (NC3) (SEQ ID NO: 522); CNP-6AAlinker-Fc (SEQ ID NO: 523); CDNP-Fc (SEQ ID NO: 524), which has no linker between the CDNP and Fc moieties; CDNP-A17saa-Fc (SEQ ID NO: 525), which has a mutation to alanine at position 17 of the CNP22 region and mutations S3, A4, and A5 in the DNP tail region; and CDNP-A17sra-Fc (SEQ ID NO: 526), which has a mutation to alanine at position 17 of the CNP22 region and mutations S3 and A5 in the DNP tail region.

Figure 27A:
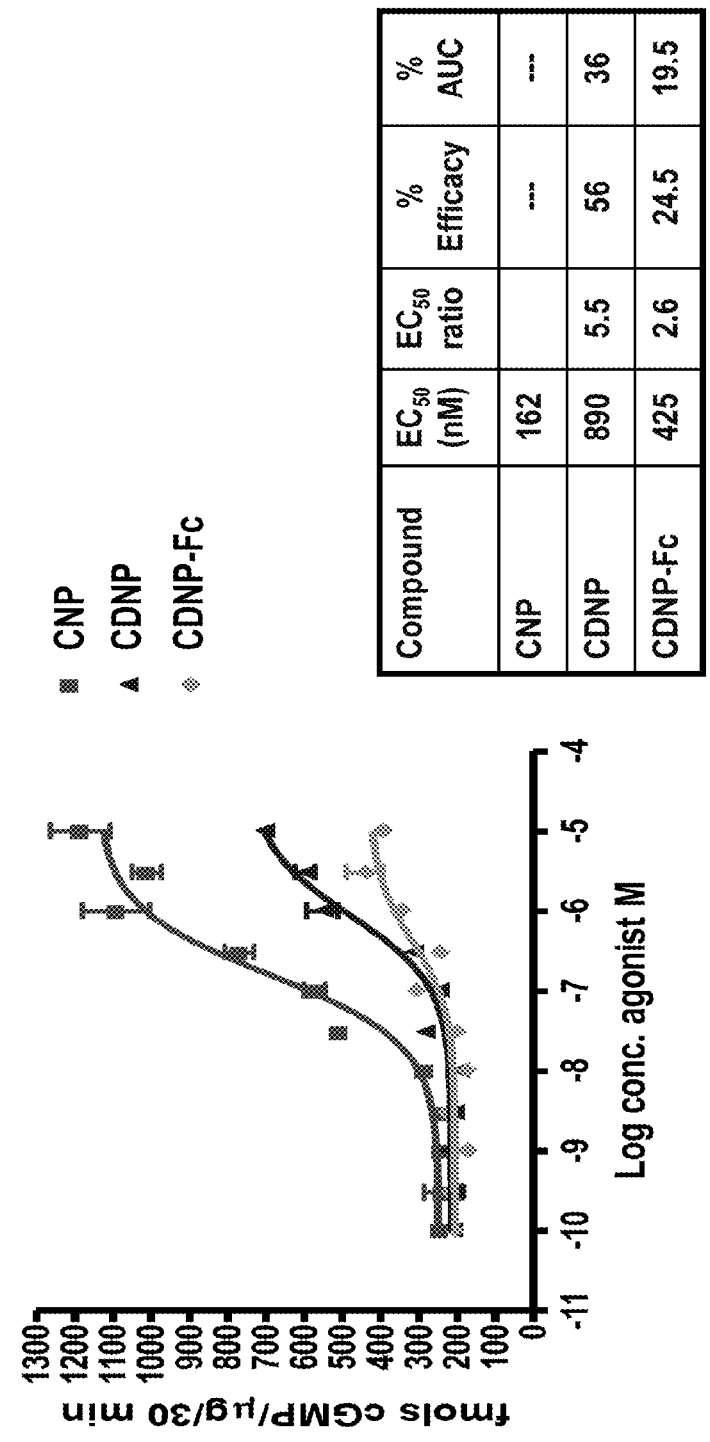
FIG. 27A is a set of dose-response curves for CNP, CDNP, and CDNP-Fc as tested in an NPR-B membrane assay, together with a table showing $EC_{50}$ values, $EC_{50}$ ratios relative to CNP, % efficacy, and % AUC.
Figure 27B:
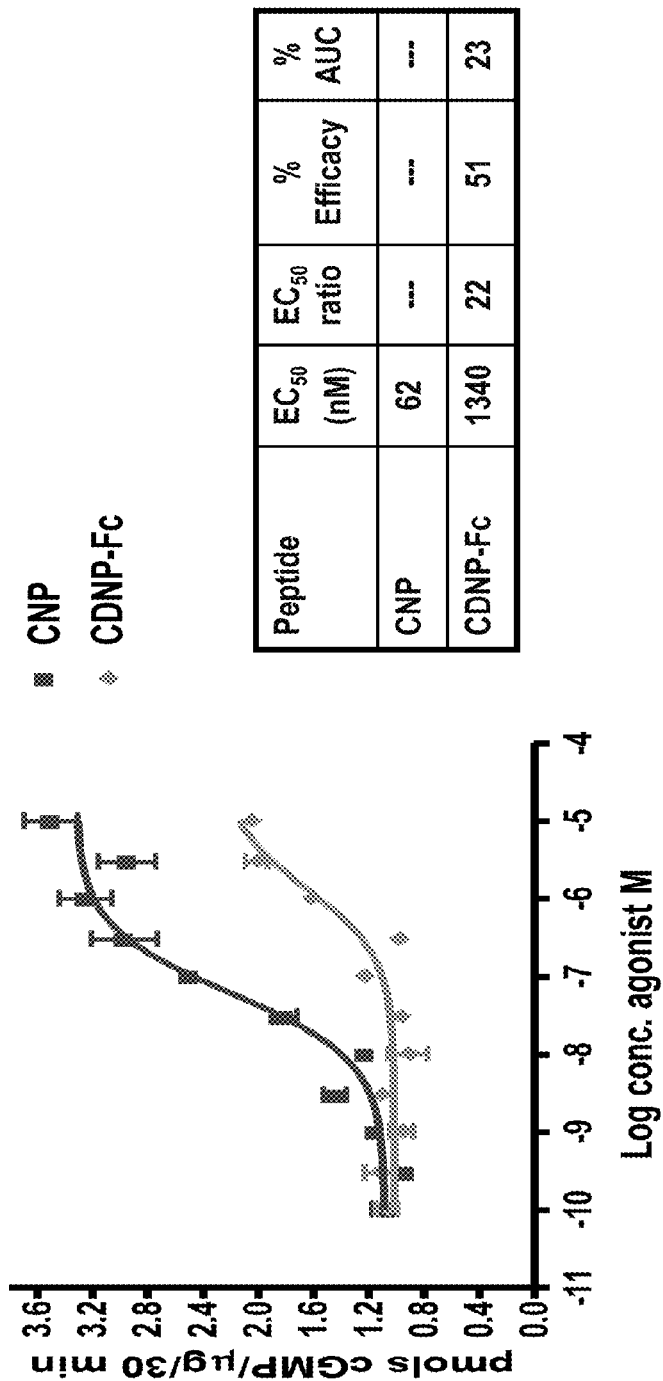
FIG. 27B is a set of dose-response curves for CNP and CDNP-Fc as tested in an NPR-B membrane assay, together with a table showing $EC_{50}$ values, $EC_{50}$ ratio relative to CNP, % efficacy, and % AUC.

In one set of experiments, dose-response NPR-B membrane assays were performed to determine relative potency and efficacy of CDNP-Fc in comparison with CDNP and CNP22. In the first set of experiments, as shown in FIG. 27A, CDNP was 5.5-fold less potent than CNP22, and had 56% of CNP22's efficacy. CDNP-Fc was only 2.6-fold less potent than CNP22 and had 24.5% of CNP22's efficacy. In the second set of experiments, as shown in FIG. 27B, CDNP-Fc was determined to be 22 times less potent and had 51% of the efficacy of CNP22.

Figure 27C:
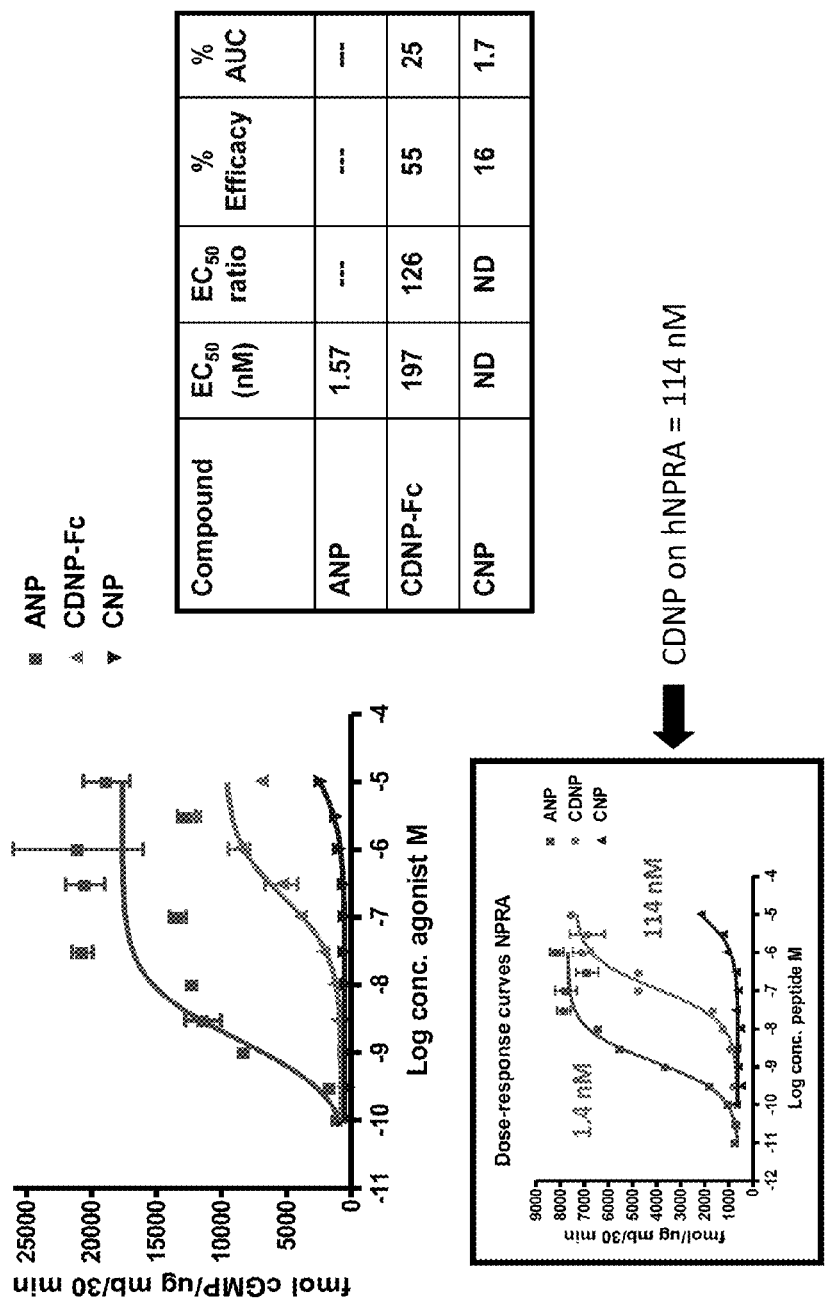
FIG. 27C is a set of dose-response curves for ANP, CNP, CDNP, and CDNP-Fc as tested in an NPR-A membrane assay, together with a table showing $EC_{50}$ values, $EC_{50}$ ratios relative to ANP, % efficacy, and % AUC.

CDNP-Fc was further assayed to determine relative potency and efficacy in agonizing NPR-A. As shown in FIG. 27C, CDNP-Fc was 126 times less potent than ANP and had 55% of the efficacy. These experiments demonstrate that CDNP-Fc retains some NPR-A agonizing activity.

Figure 28A:
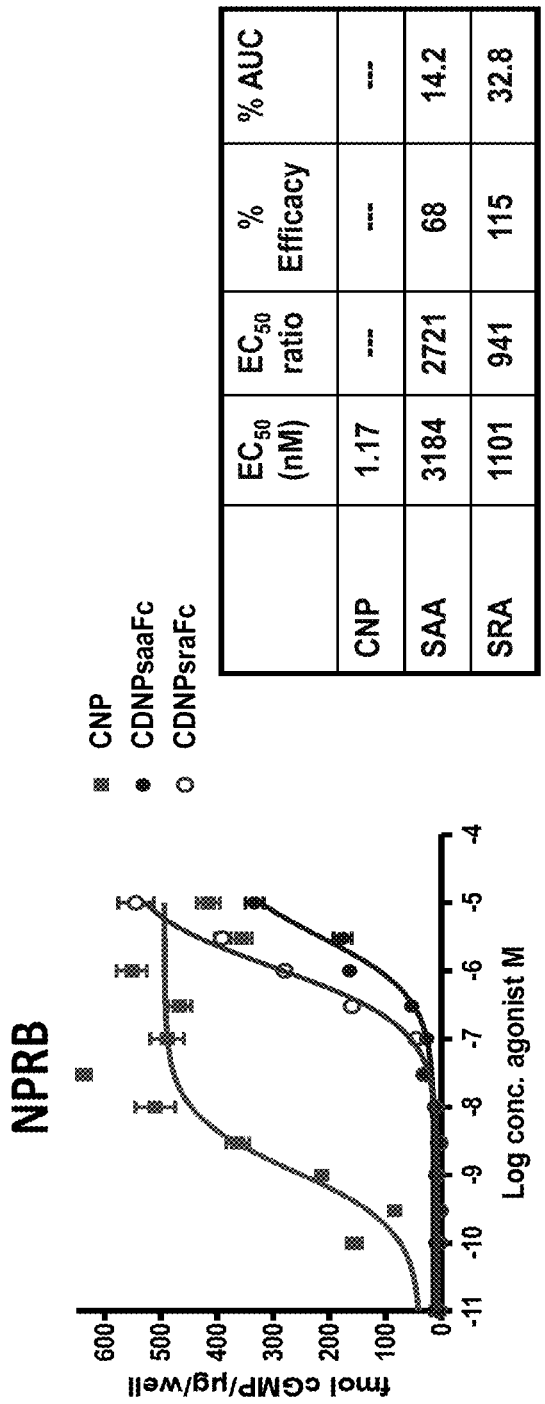
FIG. 28A is a set of dose-response curves for CNP, CDNP-(A17)S3A4A5-Fc, and CDNP-(A17)S3A5-Fc as tested in a NPR-B whole cell cGMP assay, together with a table showing $EC_{50}$ values, $EC_{50}$ ratios relative to CNP, % efficacy, and % AUC.
Figure 28B:
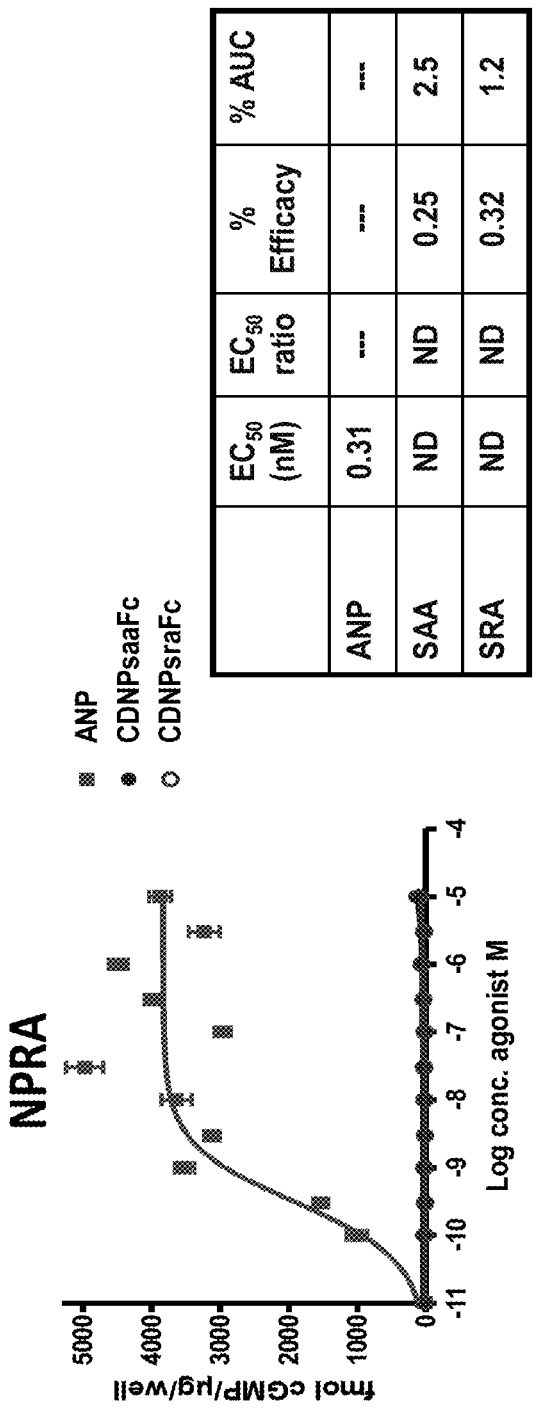
FIG. 28B is a set of dose-response curves for ANP, CDNP-(A17)S3A4A5-Fc, and CDNP-(A17)S3A5-Fc as tested in a NPR-A whole cell cGMP assay, together with a table showing $EC_{50}$ values, $EC_{50}$ ratios relative to ANP, % efficacy, and % AUC.

Next, CDNP-A17saa-Fc and CDNP-A17sra-Fc were tested in whole cell NPR-B and NPR-A assays, using CNP and ANP, respectively, as controls, to determine relative potency and efficacy in agonizing each of NPR-B and NPR-A. As shown in FIGS. 28A and 28B, CDNP-A17saa-Fc and CDNP-A17sra-Fc agonized NPR-B with 2,721 and 941-fold reduced potency relative to CNP22, respectively, and 68% and 115% efficacy, respectively. However, the potency of these constructs was undetectably small relative to ANP in the NPR-A assay. Thus, these constructs showed much-improved selectivity for NPR-B relative to CDNP-Fc.

Example 11

Point Mutants of CNP22 at Position 17

In this set of experiments, mutations were introduced into CNP22 at position 17 in order to determine whether the wild-type residue at this position, methionine, could be replaced with a residue that is less sensitive to oxidation without substantially reducing potency or efficacy. Residue 17 is one of the less well-conserved positions in CNP22, with naturally-occurring homologs having (without limitation) Phe, Leu, Ile, Thr, Val, or Ser at this position (see, e.g., FIG. 3). Accordingly, the following CNP22 variants were prepared: CNP-F17 (SEQ ID NO: 119); CNP-L17 (SEQ ID NO: 120); CNP-I17 (SEQ ID NO: 121); CNP-T17 (SEQ ID NO: 122); CNP-V17 (SEQ ID NO: 123); CNP-A17 (SEQ ID NO: 124); CNP-S17 (SEQ ID NO: 125); CNP-E17 (SEQ ID NO: 156); CNP-R17 (SEQ ID NO: 157); and CNP-Y17 (SEQ ID NO: 158), where the consensus sequence is shown in SEQ ID NO: 126 (where X can be any amino acid, including, without limitation, Phe, Leu, Ile, Thr, Glu, Arg, Tyr, Cys, Pro, Asp, Val, Ala, or Ser) (FIG. 29).

Figure 30:
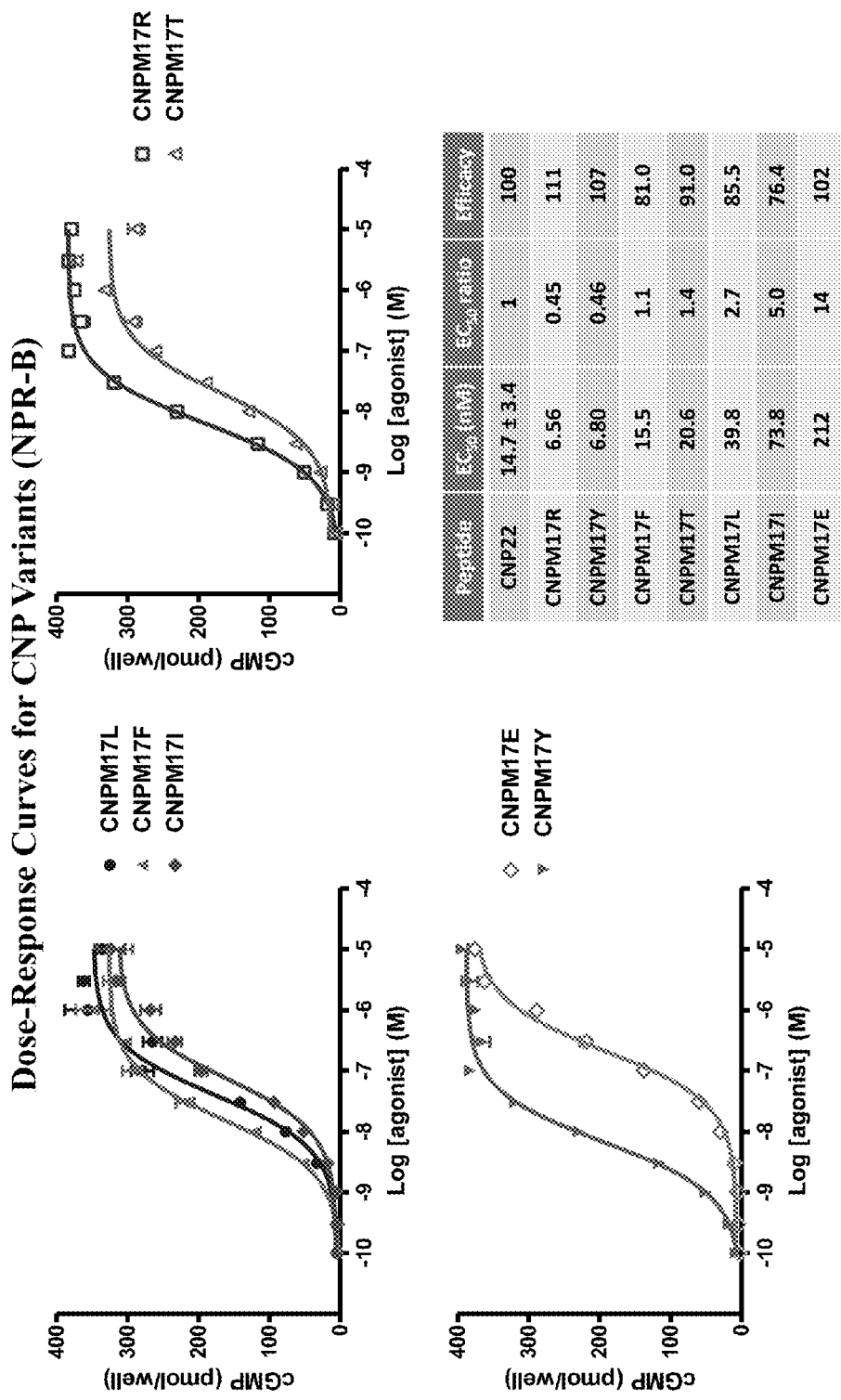
FIG. 30 is a set of dose-response curves for CNP and several variants (CNP-F17, CNP-L17, CNP-I17, CNP-T17, and CNP-V17) as tested in a NPR-B whole cell cGMP assay, together with a table showing $EC_{50}$ and % efficacy values.

As shown in FIG. 30, various variants were assayed. Variants CNP-R17 and CNP-Y17 showed improved potency, and CNP-F 17, CNP-L 17, and CNP-T 17 exhibited comparable potency to CNP22. Thus, these results demonstrate that the CNP22 molecule may be modified at position 17 in order to eliminate the oxidation-sensitive methionine residue while maintaining comparable potency.

Example 12

CNP22 Variants and Bone-Targeted NPs

Variants of CNP22 may be designed, e.g., to be resistant to NEP or IDE degradation and retain adequate potency, and/or to include a bone-targeting moiety at the N terminus or C terminus. Exemplary molecules are shown in FIG. 31 (SEQ ID NOs: 127-150). Variants of the molecules shown in FIG. 31 or otherwise described herein may also be utilized, e.g., lacking the bone-targeting moiety, or containing a different bone-targeting moiety. For example, any of $E_6$, $E_7$, $E_8$, $E_9$, $E_{10}$, $E_{11}$, $E_{12}$, $E_{13}$, $E_{14}$, $E_{15}$, $E_{16}$, $D_6$, $D_7$, $D_8$, $D_9$, $D_{10}$, $D_{11}$, $D_{12}$, $D_{13}$, $D_{14}$, $D_{15}$, or $D_{16}$ may be used as a bone-targeting moiety. A linker, e.g., a flexible linker, may be included between the bone-targeting moiety and the NP. In addition, any of the molecules shown in FIG. 31, with or without the bone-targeting moiety, may be fused to an Fc domain and may optionally further include a linker region between the Fc and NP, as disclosed herein. In addition, the italicized regions in FIG. 31 may be used as N-terminal extensions, C-terminal extensions, and/or linkers for any of the NPs disclosed herein.

Example 13

Additional CNP Variants

Additional variants of CNP may be designed, e.g., to be resistant to NEP or IDE degradation and retain adequate potency, and/or to include a bone-targeting moiety at the N terminus or C terminus. Exemplary molecules are shown in FIGS. 32A-32E (SEQ ID NOs: 1001-1155). Variants of the molecules shown in FIGS. 32A-32E or otherwise described herein may also be utilized, e.g., including a bone-targeting moiety. For example, any of $E_6$, $E_7$, $E_8$, $E_9$, $E_{10}$, $E_{11}$, $E_{12}$, $E_{13}$, $E_{14}$, $E_{15}$, $E_{16}$, $D_6$, $D_7$, $D_8$, $D_9$, $D_{10}$, $D_{11}$, $D_{12}$, $D_{13}$, $D_{14}$, $D_{15}$, or $D_{16}$ may be used as a bone-targeting moiety. A linker, e.g., a flexible linker, may be included between the bone-targeting moiety and the NP. In addition, any of the molecules shown in FIGS. 32A-32E, with or without the bone-targeting moiety, may be fused to an Fc domain and may optionally further include a linker region between the Fc and NP, as disclosed herein.

Example 14

Evaluation of Daily Bolus Subcutaneous Injection of NC2st on Bone Growth in Wild-Type (CD-1) Mice Objective The study was designed to evaluate the relationship between different doses of NC2st and the pharmacologic response on bone. The relationship was evaluated by measuring the effect of increasing doses of NC2st (SEQ ID NO: 502; as described, e.g., in Example 1) on bone growth in wild-type (WT, CD-1) mice. Bone growth response of wild-type and $Fgfr3^{369/+}$ (ACH) mice was compared.

Test Article

Test article: NC2st formulated in 25 mM sodium phosphate, 150 mM NaCl, pH 7.4.

Control article: Vehicle, 25 mM sodium phosphate, 150 mM NaCl, pH 7.4.

Test System

CD-1 mice are a standard rodent species for use in pharmacodynamic studies. Briefly, nursing mothers with fostered female pups of 13 to 16 days were obtained. At the age of 21 days, pups were weaned and randomized based on body weight into treatment groups.

Experimental Design

The animals received NC2st as a subcutaneous injection into the interscapular region as described in Table 11 below.

TABLE 11

| Group No. | Group description | ROA | Duration of treatment (days) | Dosing Interval | Dose Level (mg/kg) | WT (CD-1, female) N = |
|---|---|---|---|---|---|---|
| 1 | V | SC injection | 35 | Once daily | 0 | 16 |
| 2 | Tx-10 | SC injection | 35 | Once daily | 10 | 16 |
| 3 | Tx-30 | SC injection | 35 | Once daily | 30 | 16 |
| 4 | Tx-100 | SC injection | 35 | Once daily | 100 | 16 |

ROA: route of administration

CD-1 mice were treated at 3 weeks old at the indicated doses for 35 consecutive days, followed by necropsy 24 hours after the last injection. A summary of the study endpoints is shown in Table 12.

TABLE 12

| Endpoints | Day 1 → Day 36 | Occasions Day 1, 8, 15, 22, 29, 36 | Necropsy Day 36 |
|---|---|---|---|
| Body weight | √ | | √ |
| Crown-rump length (CRL) | | √ | √ |
| Tail length | | √ | √ |
| Bone length: right tibia | | √ | √ |
| Bone length: left tibia, left femur, left humerus, and left ulna | | | √ |
| Whole body X-Ray | | | |
| Naso-anal length | | | √ |
| Cervical-Thoracic-Lumbar (CTL) length | | | √ |
| Sternum length | | | √ |
| Metatarsal bone length | | | √ |
| Foramen magnum width and height | | | √ |
| Skull morphology | | | √ |

Experimental Procedures

Mortality checks were performed each day and noted in study books. The animals were examined each day. If present, clinical signs were noted in study books.

The animals were euthanized by a bilateral thoracotomy under isoflurane anesthesia and a gross pathology check was performed. All gross pathology check findings were reported in study books.

Ex vivo radiographs of whole body, rib cage, and skull were taken using a Faxitron model MX-20 DC4 under constant conditions (26 kV, 10 sec at 1×, 3× and 3× magnification, respectively). Bone measurements were performed on the radiographic images of all animals in a blinded fashion using the software Image Processing and Analysis in Java (ImageJ).

Bone samples were cleaned of excess tissue (not scraped) and fixed. Length of femur and tibia was measured using a caliper.

Results

Figure 33A:
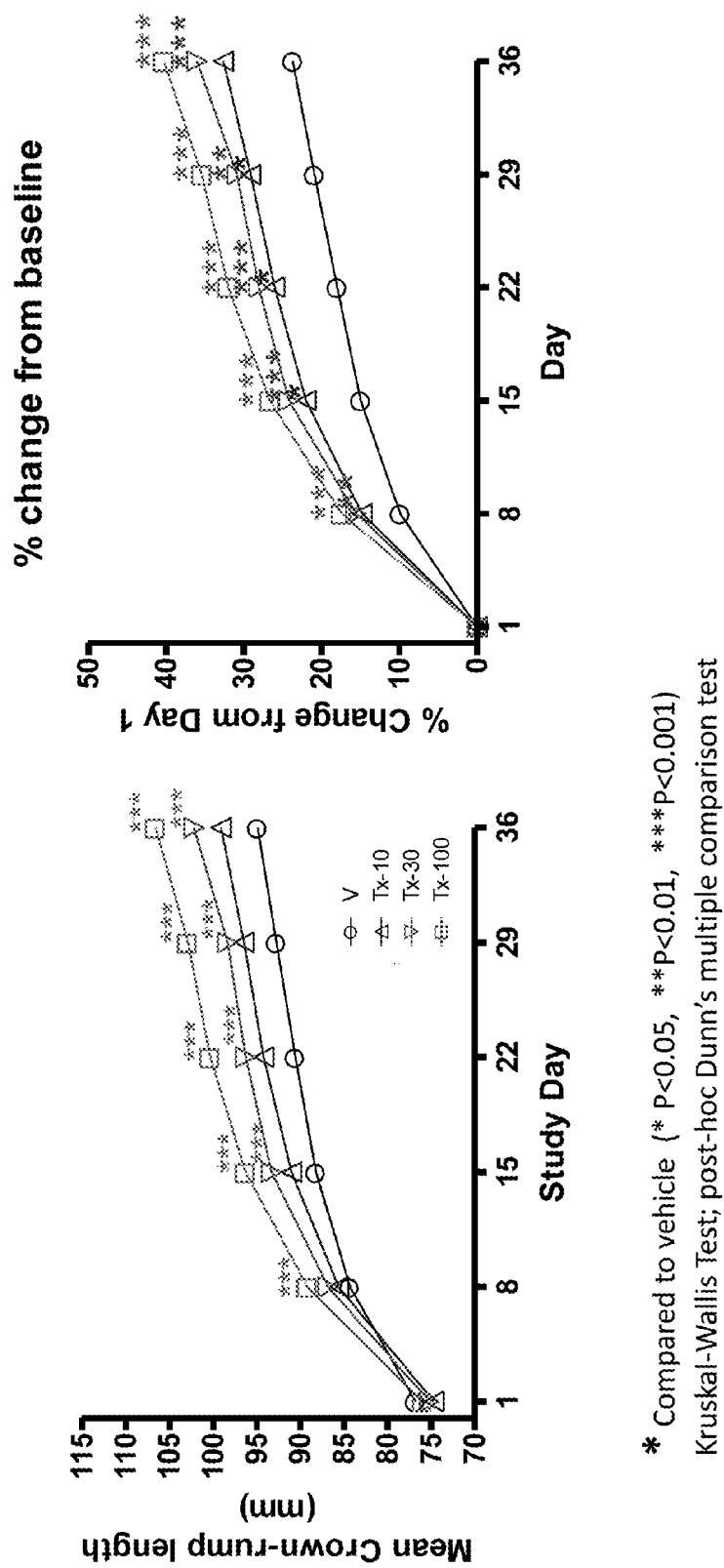
FIGS. 33A-33Y summarize the results of an efficacy study in wild-type (CD-1) mice. Each figure includes one or two charts showing the results of various measurements in vivo or following necropsy, together with corresponding tables showing statistical analysis of the data.
Figure 33B:
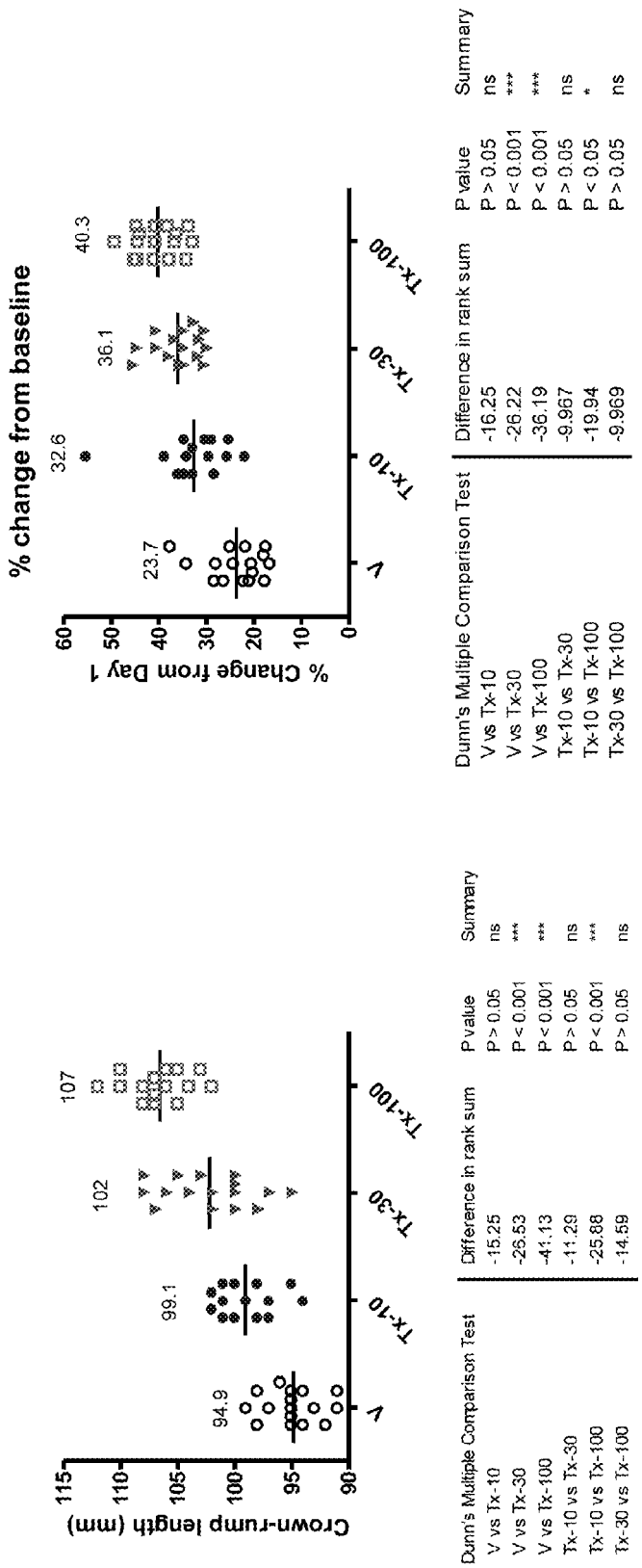
FIG. 33B shows the results of crown-rump length measurements in vivo at day 36.
Figure 33D:
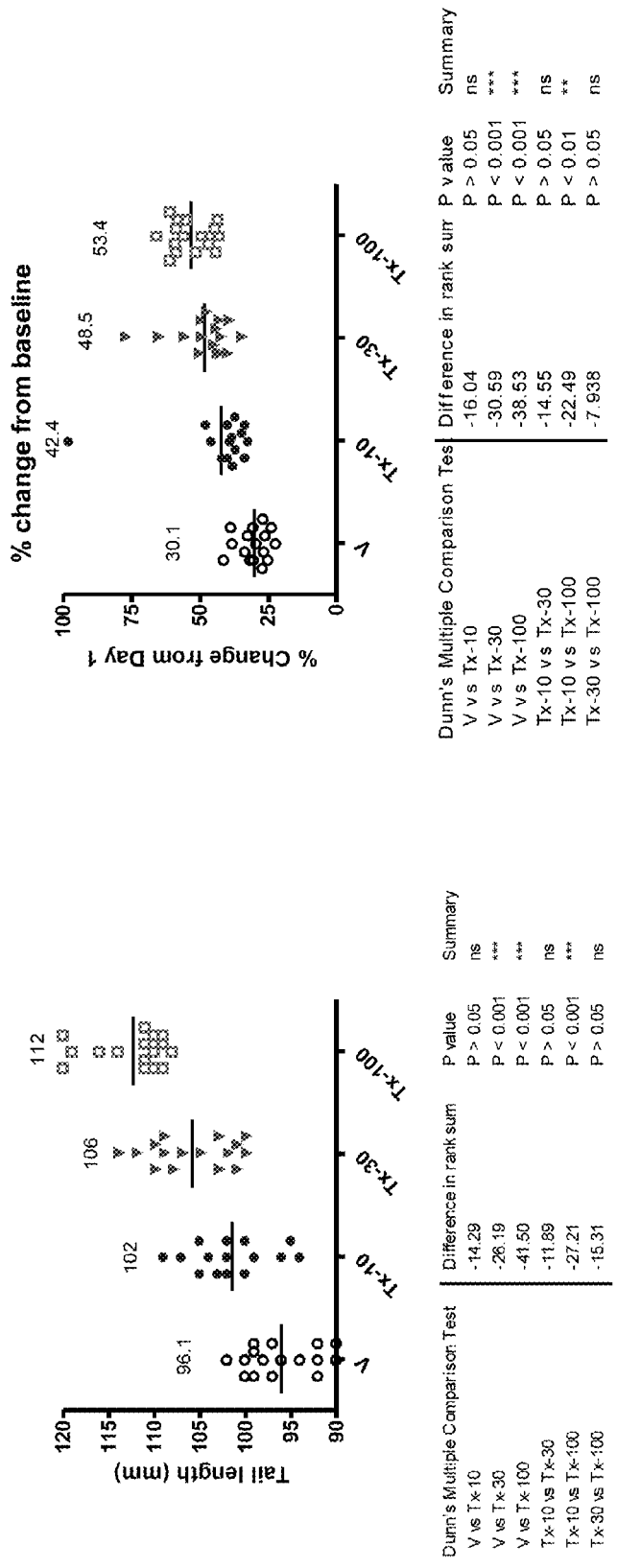
FIG. 33D shows the results of mean tail length measurements in vivo at day 36.
Figure 33E:
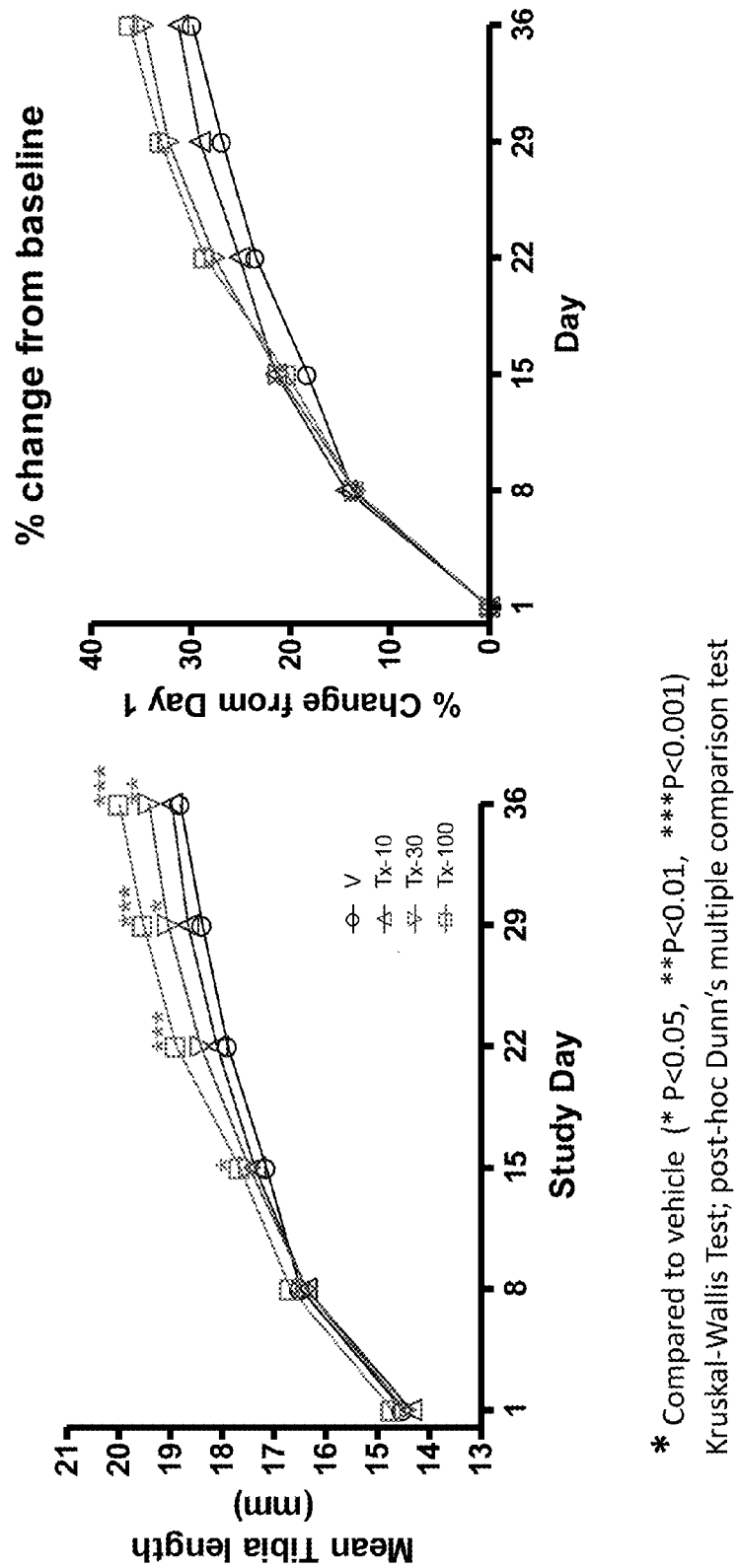
FIG. 33E shows the results of mean right tibia length measurements in vivo over 36 study days.
Figure 33F:
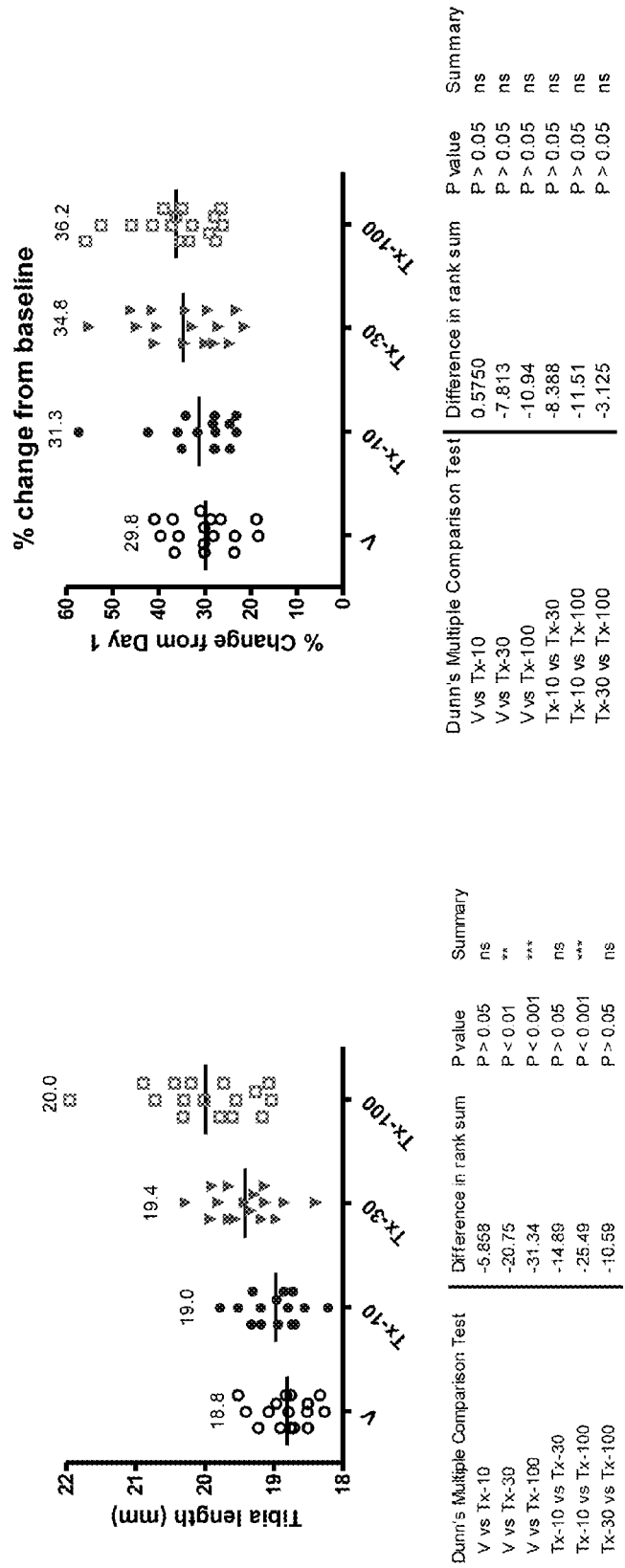
FIG. 33F shows the results of mean right tibia length measurements in vivo at day 36.
Figure 33G:
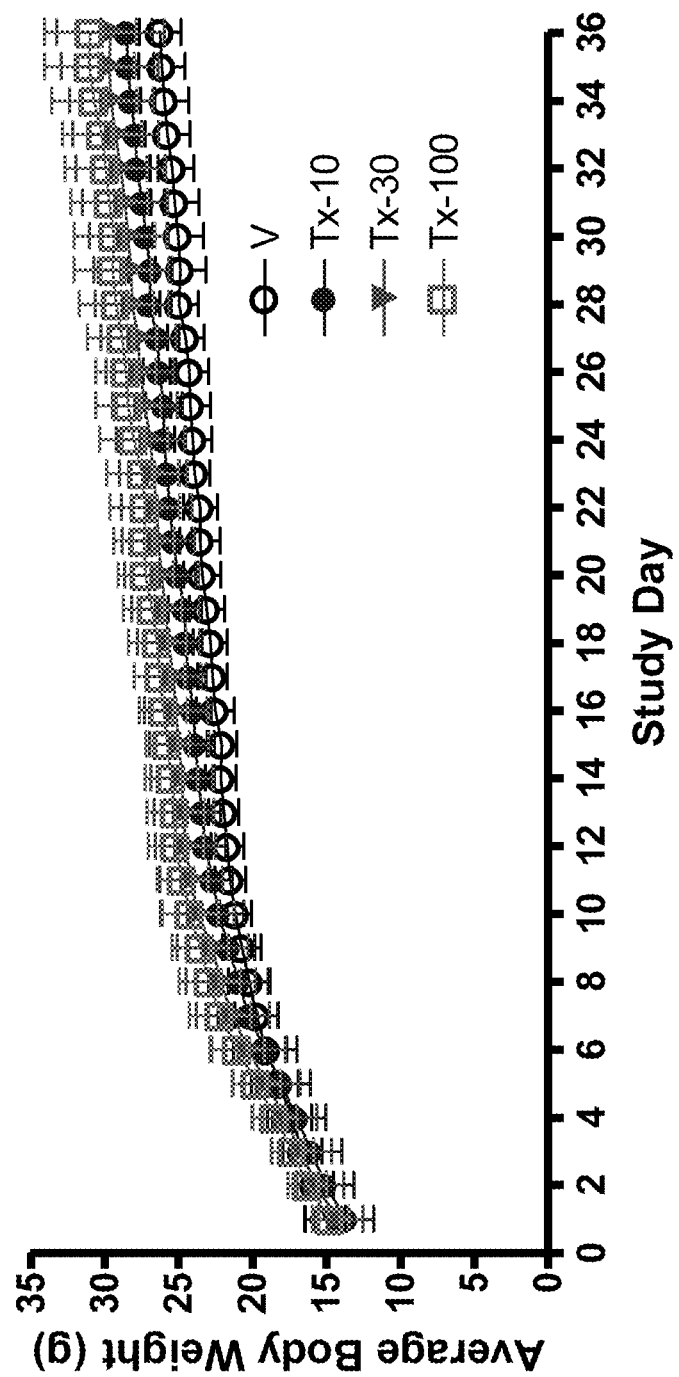
FIG. 33G shows the results of average body weight measurements in vivo over 36 study days.
Figure 33I:
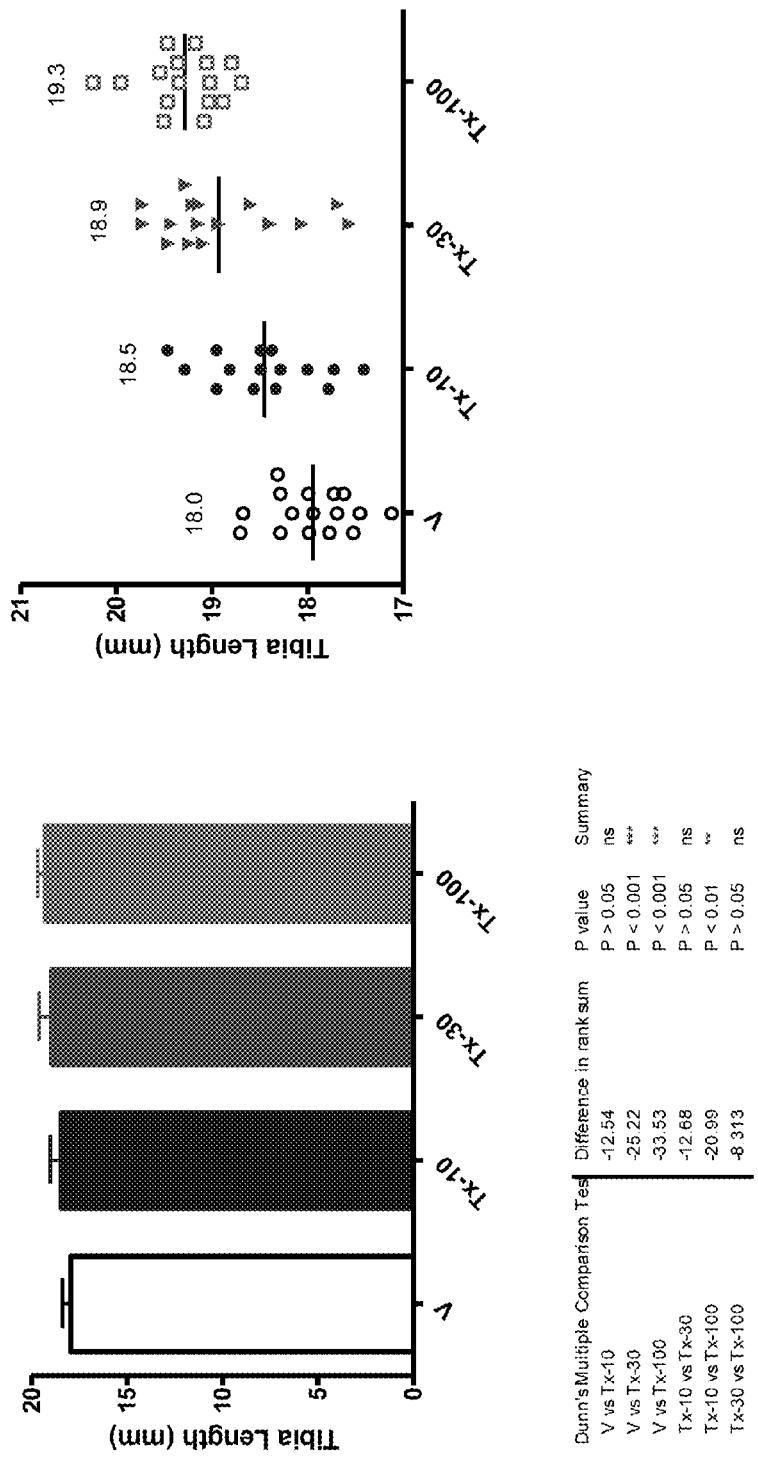
FIG. 33I shows the results of left tibia length measurements following necropsy.
Figure 33J:
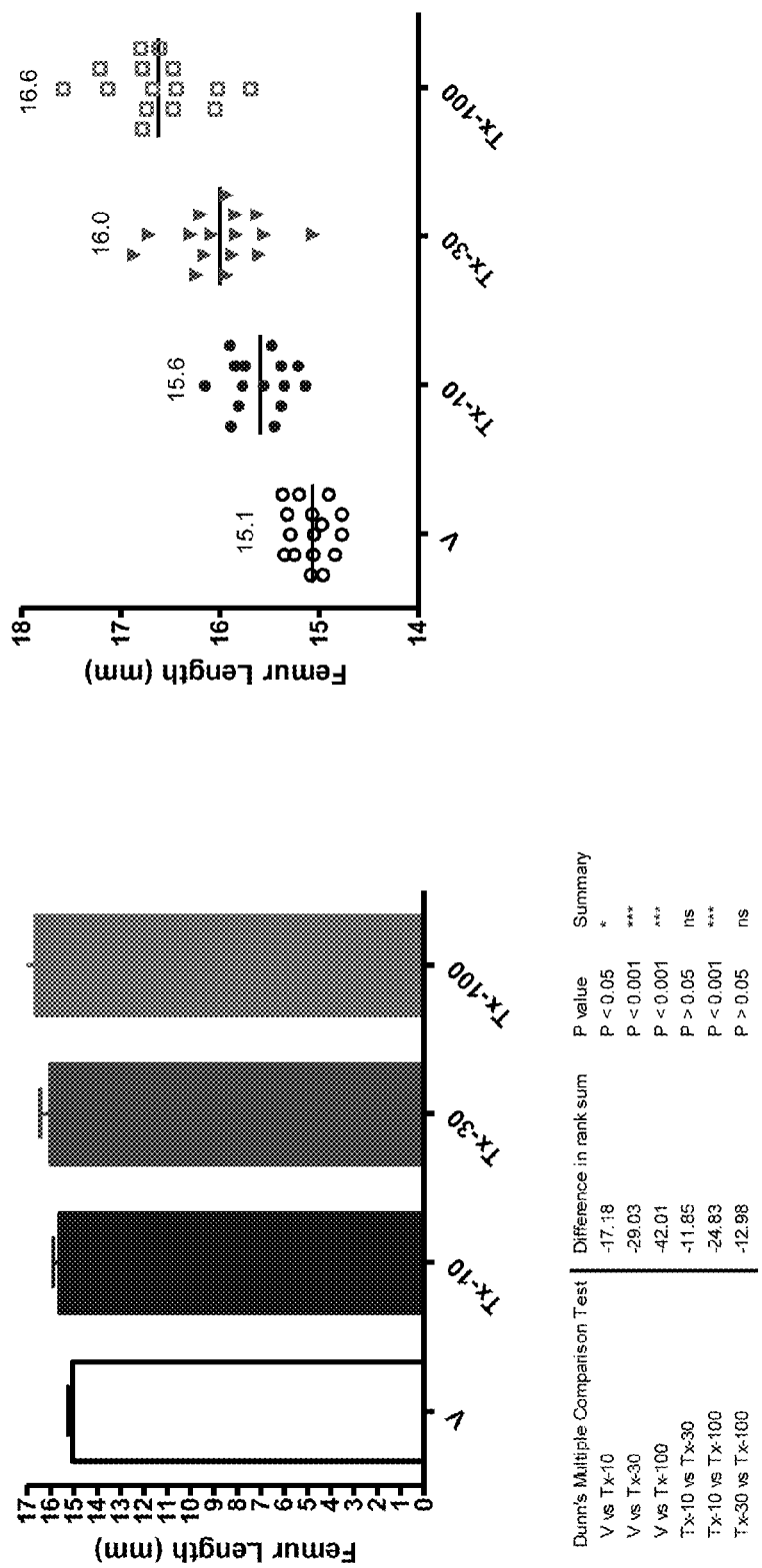
FIG. 33J shows the results of left femur length measurements following necropsy.
Figure 33K:
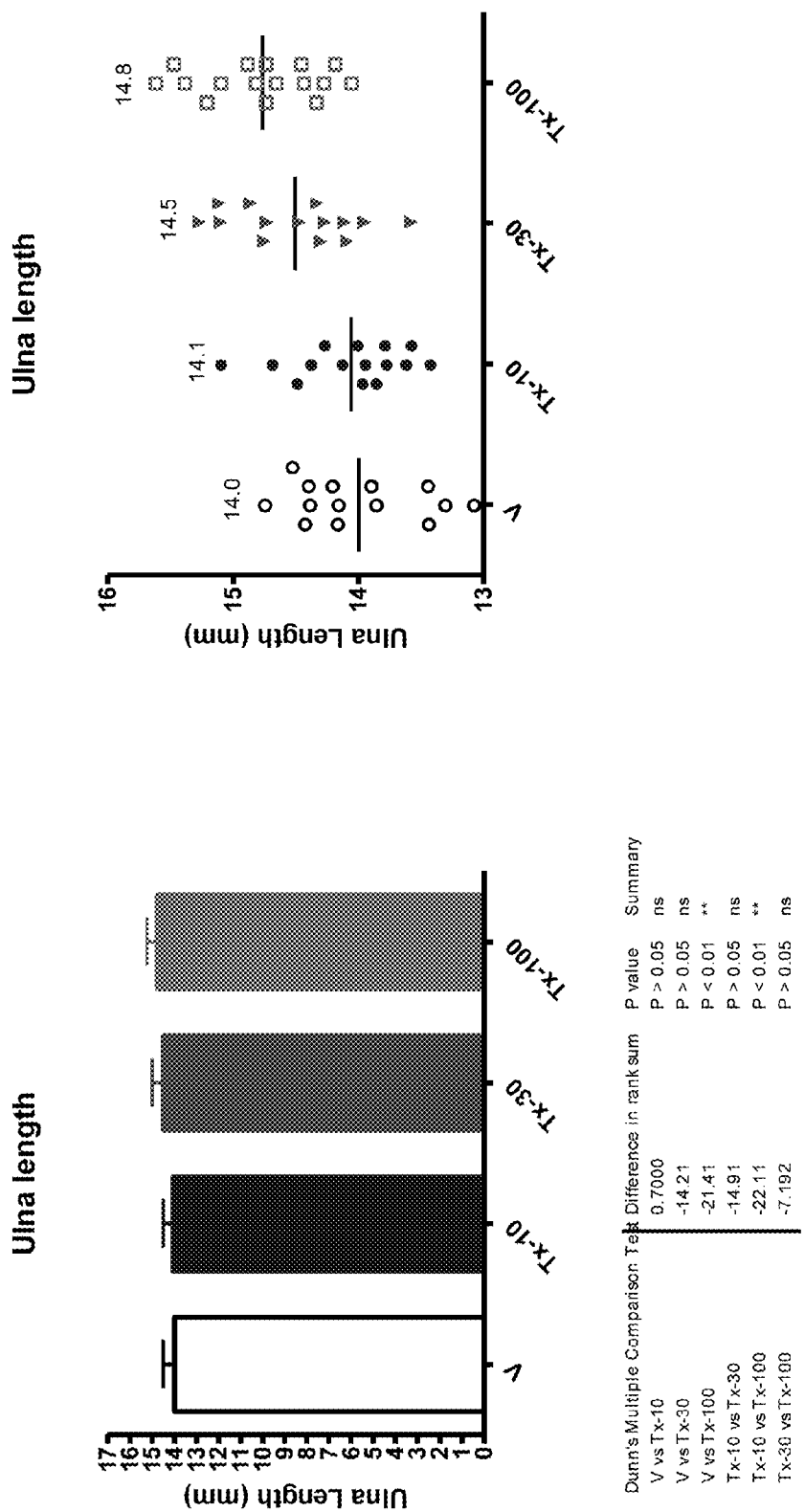
FIG. 33K shows the results of left ulna length measurements following necropsy.
Figure 33L:
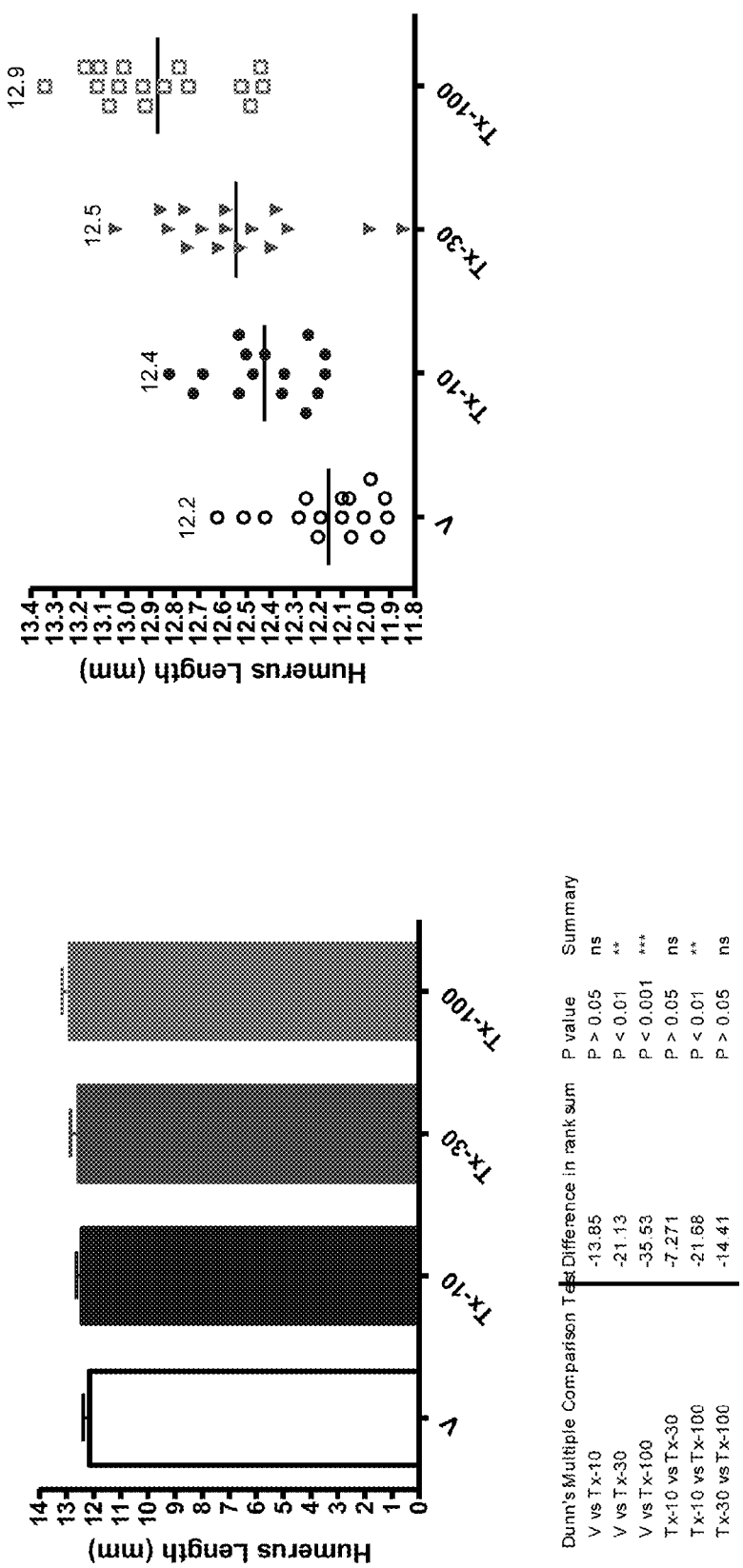
FIG. 33L shows the results of left humerus length measurements following necropsy.
Figure 33M:
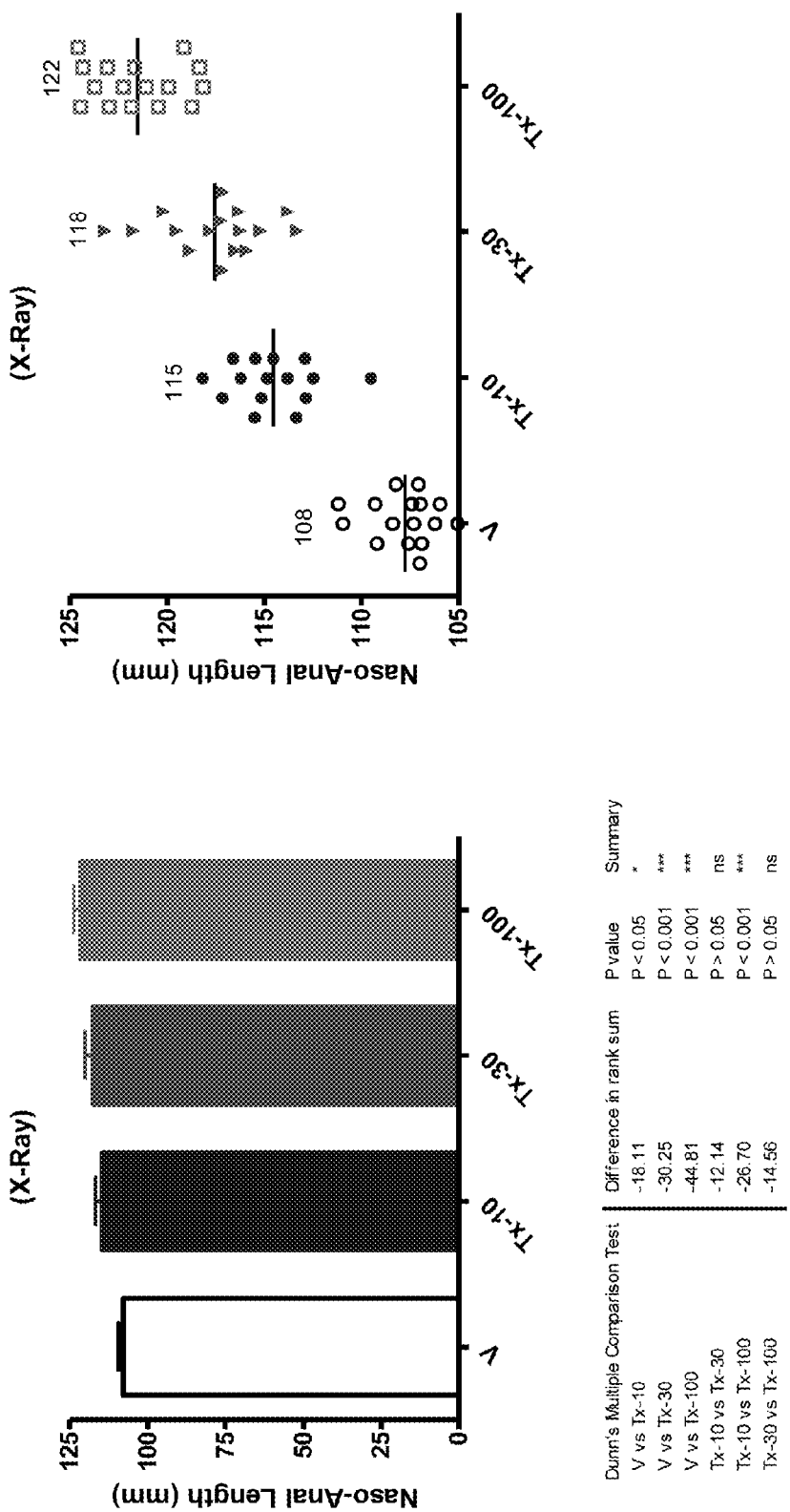
FIG. 33M shows the results of naso-anal length measurements following necropsy.
Figure 33N:
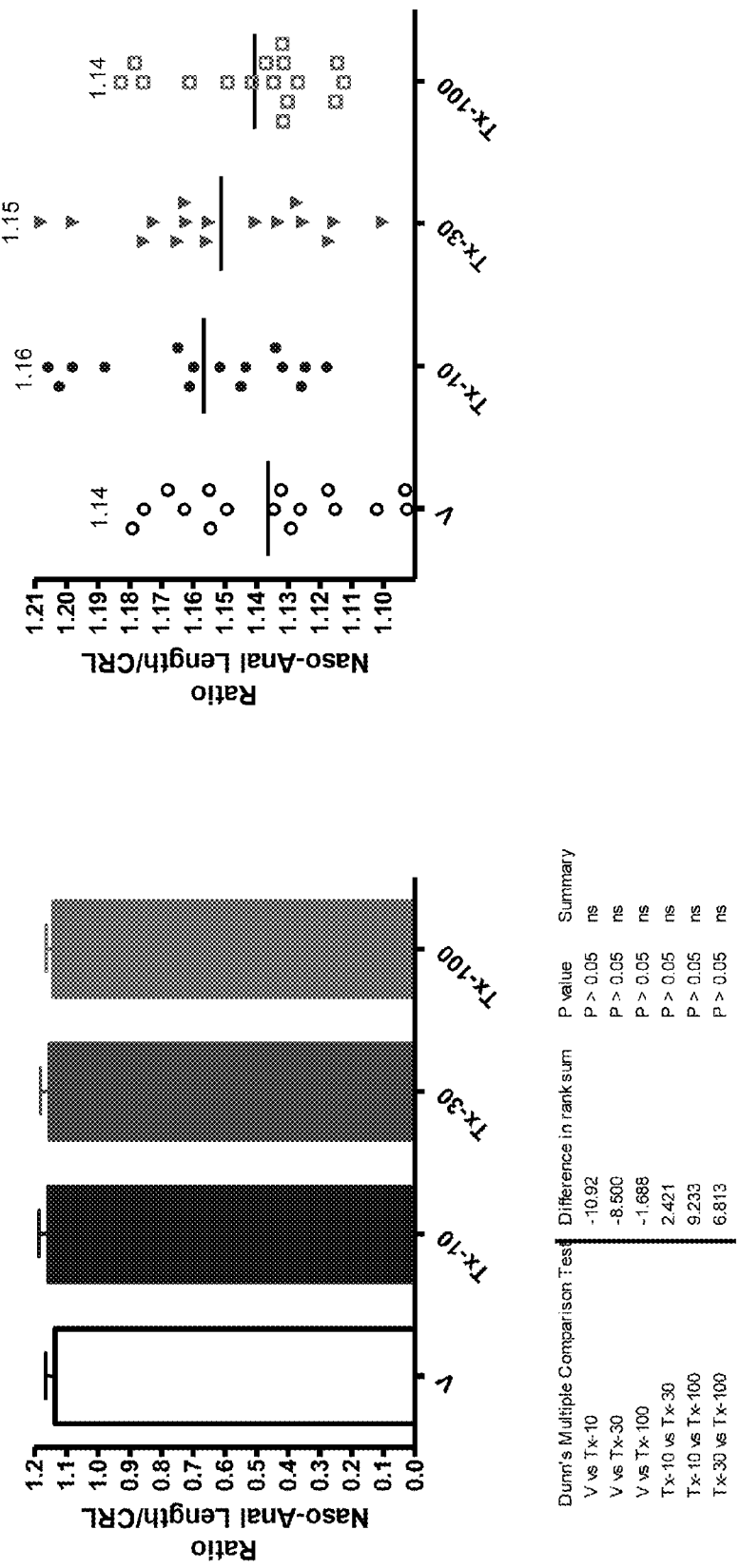
FIG. 33N shows the ratio of naso-anal length measurements to crown rump length (CRL) measurements following necropsy.
Figure 33O:
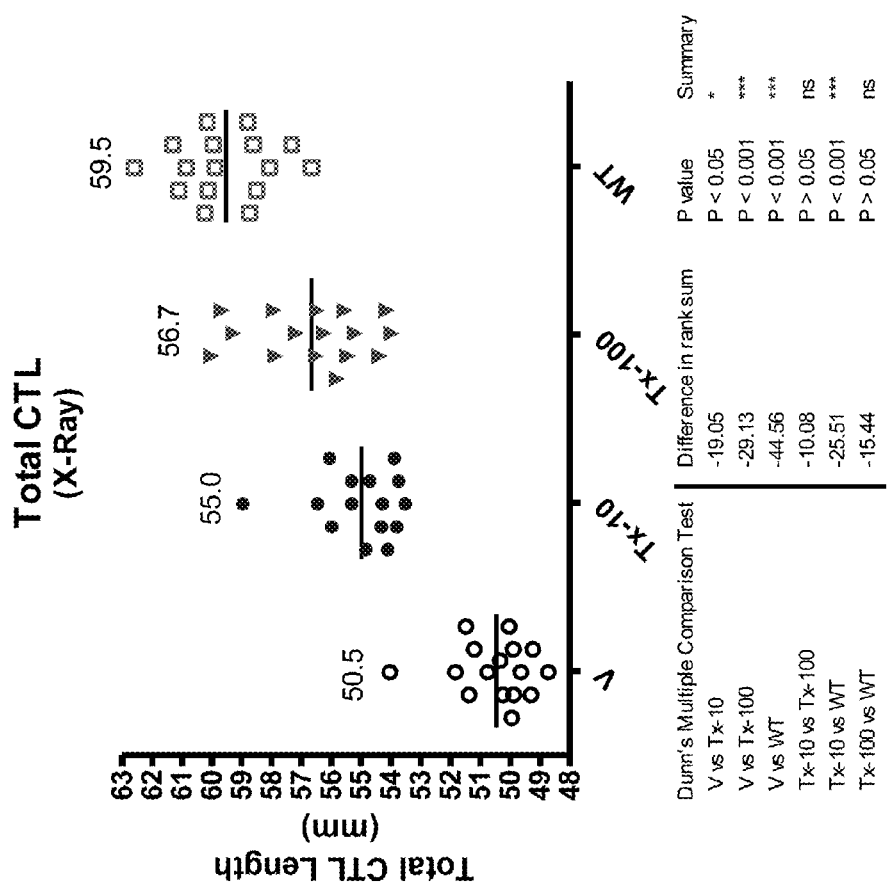
FIG. 33O shows the results of total cervical, thoracic, and lumbar (CTL) length measurements following necropsy.
Figure 33P:
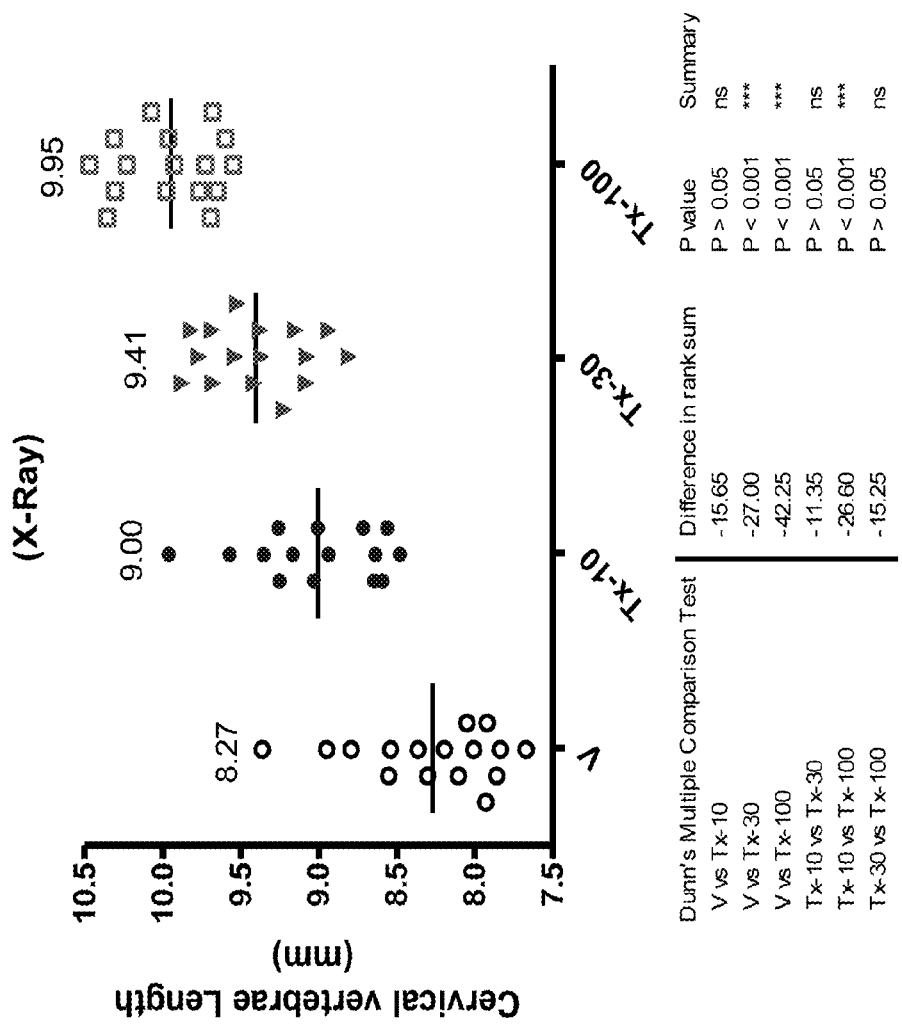
FIG. 33P shows the results of cervical vertebrae length measurements following necropsy.
Figure 33Q:
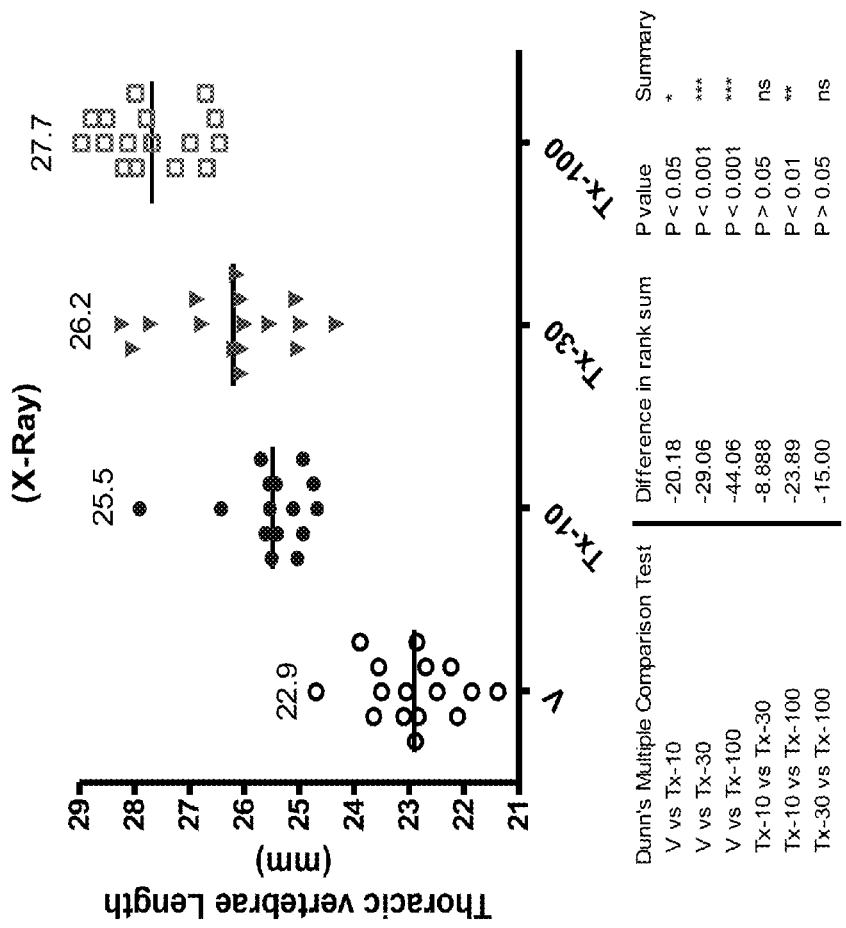
FIG. 33Q shows the results of thoracic vertebrae length measurements following necropsy.
Figure 33R:
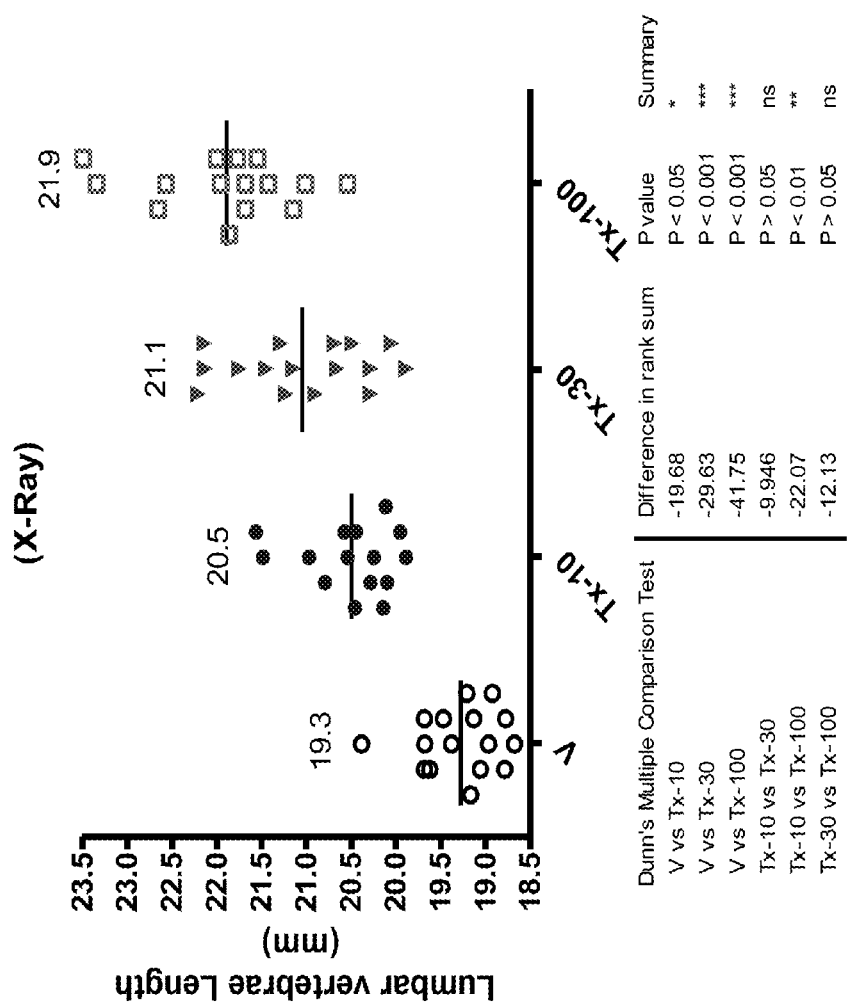
FIG. 33R shows the results of lumbar vertebrae length measurements following necropsy.
Figure 33S:
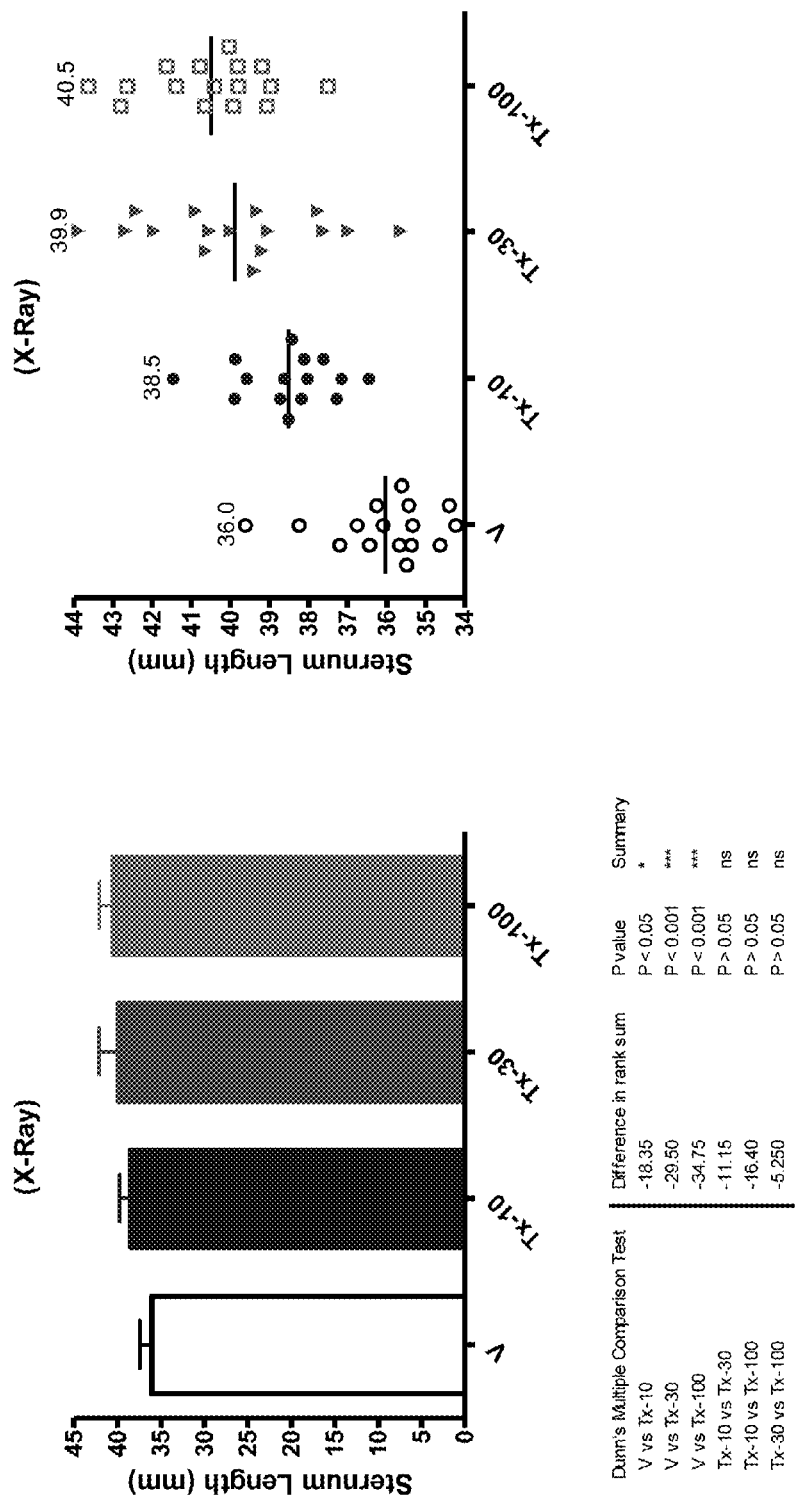
FIG. 33S shows the results of sternum length measurements following necropsy.
Figure 33U:
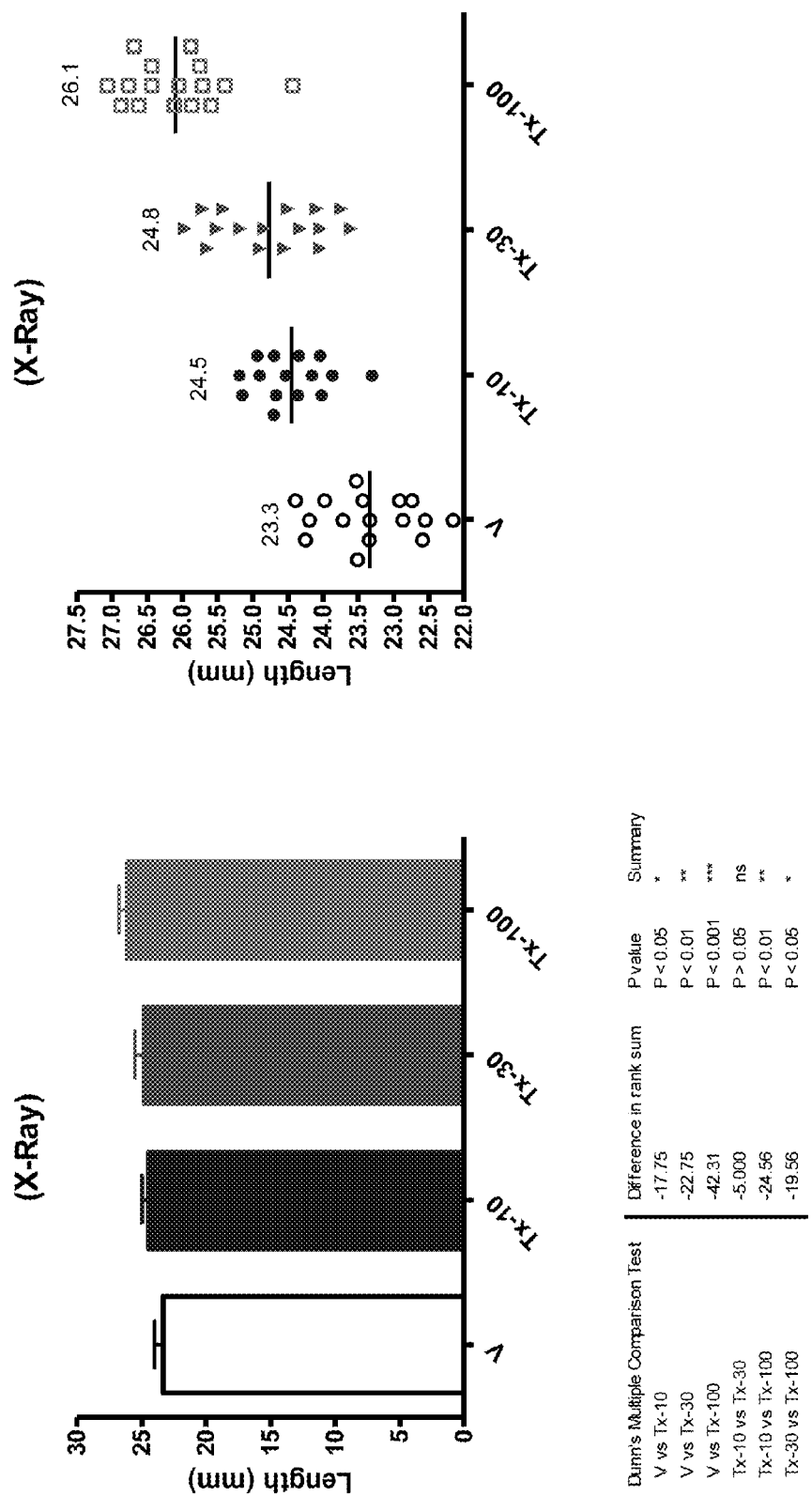
FIG. 33U shows the results of metatarsal bone (third digit) length measurements following necropsy.
Figure 33W:
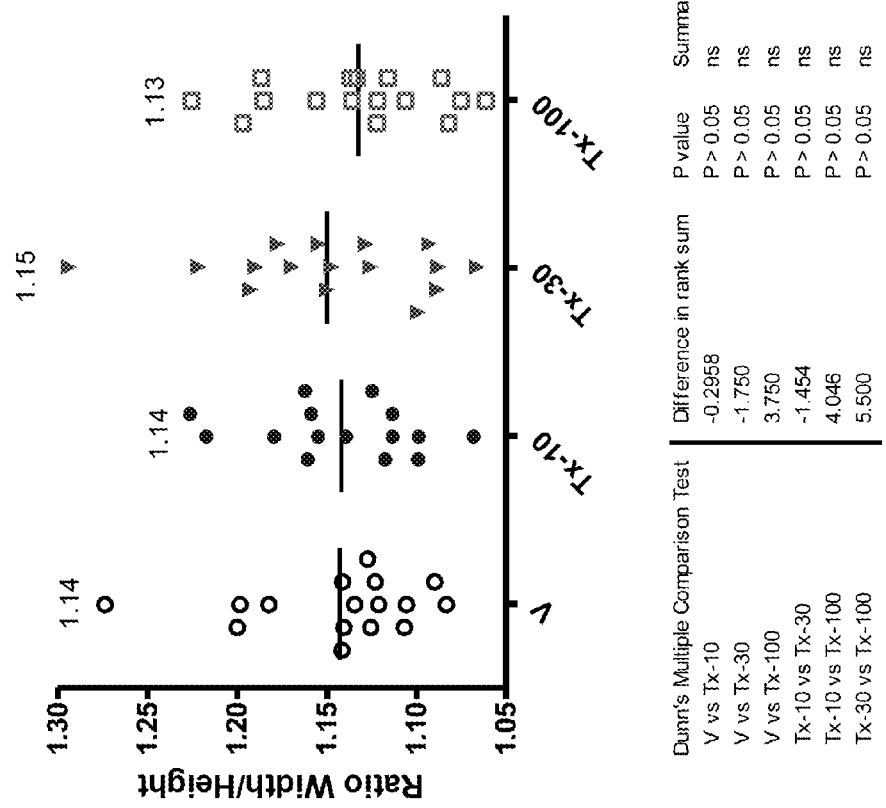
FIG. 33W shows the ratio of foramen magnum width measurements to foramen magnum height measurements following necropsy.
Figure 33X:
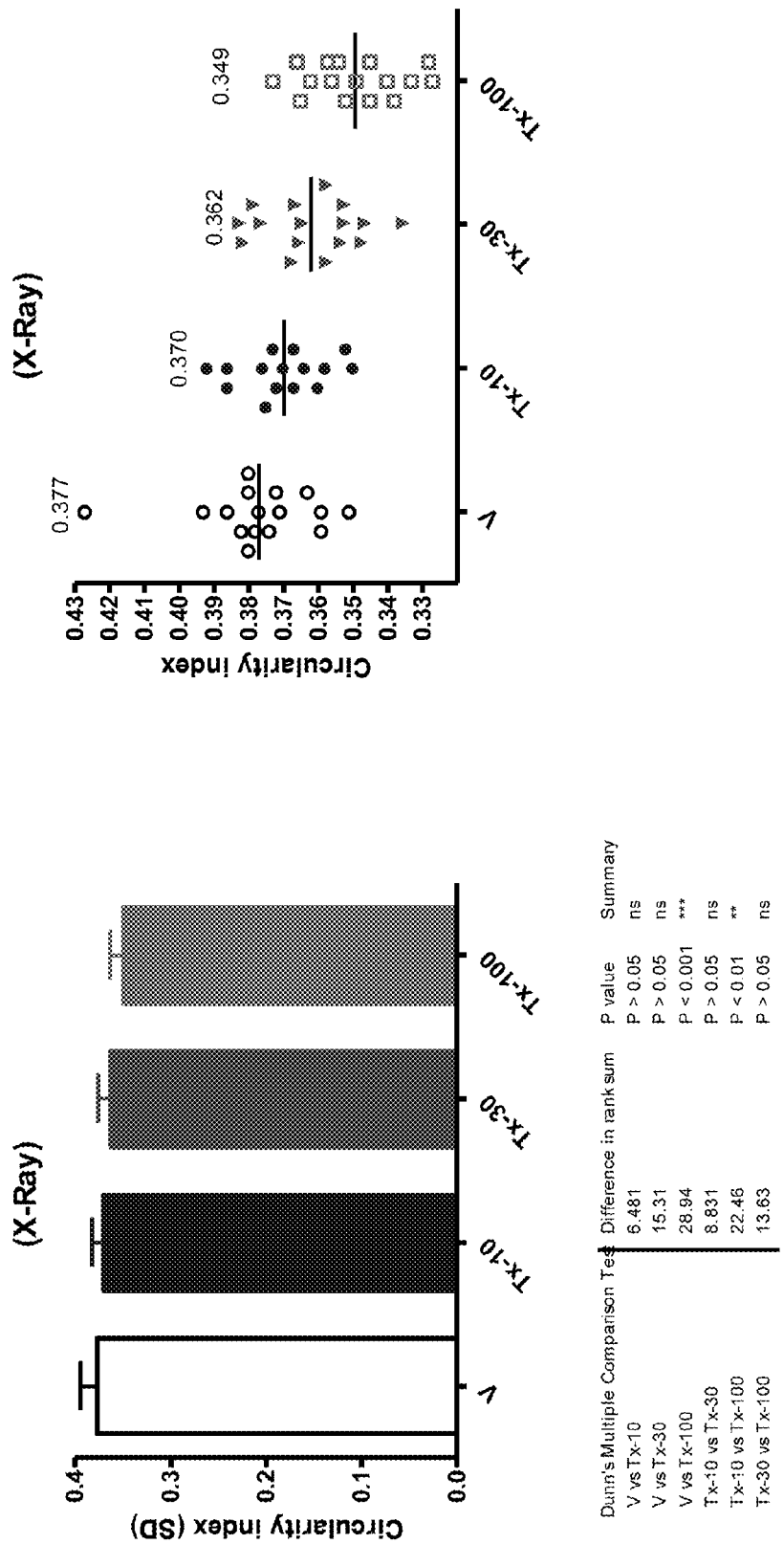
FIG. 33X shows the results of skull circularity index measurements following necropsy.
Figure 33Y:
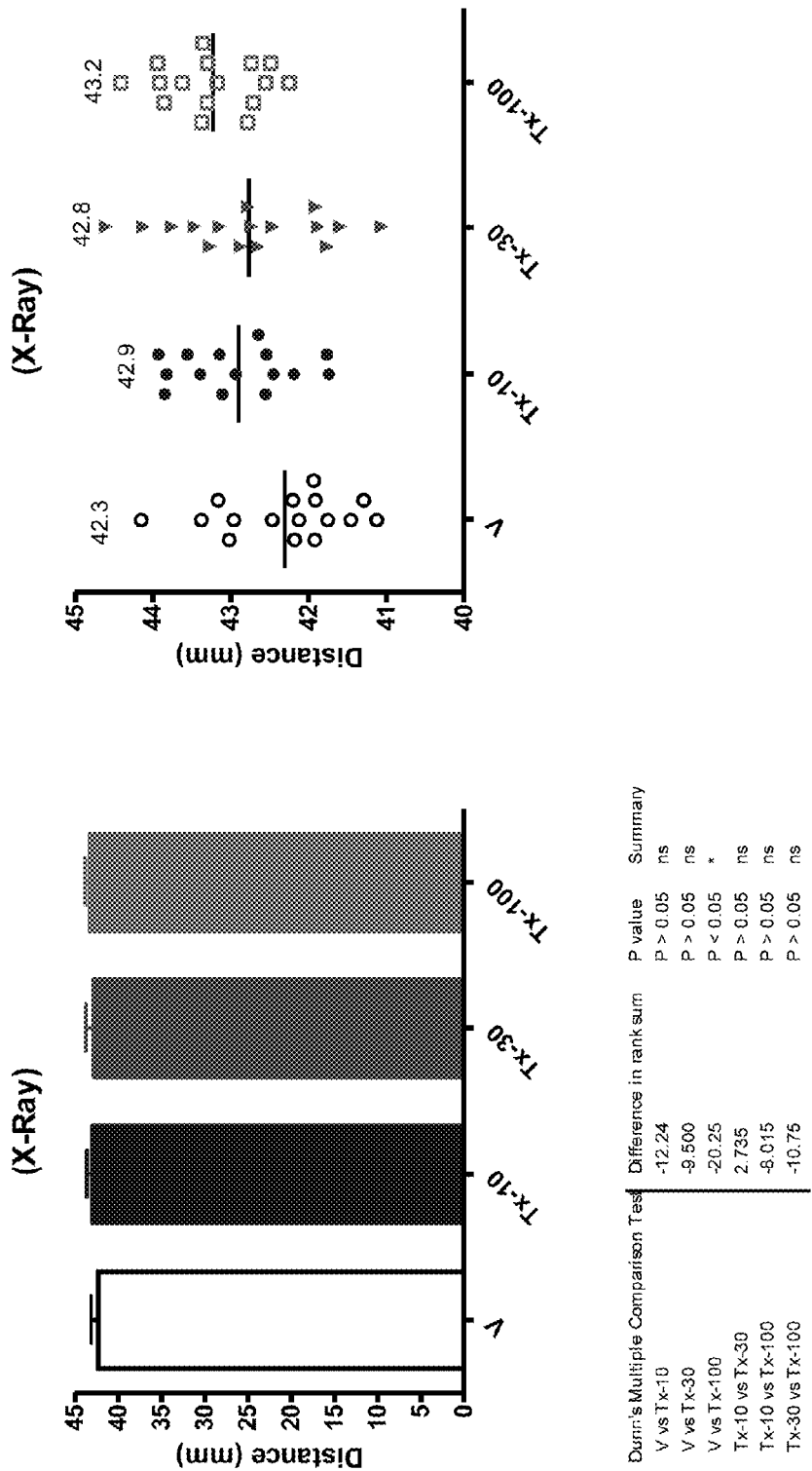

Experimental results are shown in FIGS. 33A-33Y and are summarized in Table 13 (results at day 36) below.

TABLE 13

| Length measurement[a] | V | Tx-10 | Tx-30 | Tx-100 |
|---|---|---|---|---|
| Right Tibia length in vivo (mm) | 18.8 | 19.0 | 19.4* | 20.0* |
| Δ | — | 0.20 | 0.60 | 1.2 |
| % Δ | — | 1.1 | 3.2 | 6.4 |
| Left Tibia length (mm) | 18.0 | 18.5 | 18.9* | 19.3* |
| Δ | — | 0.5 | 0.9 | 1.3 |
| % Δ | — | 2.8 | 5.0 | 7.2 |
| Left Femur length (mm) | 15.1 | 15.6* | 16.0* | 16.6* |
| Δ | — | 0.5 | 0.9 | 1.5 |
| % Δ | — | 3.3 | 6.0 | 9.9 |
| Left Ulna length (mm) | 14.0 | 14.1 | 14.5 | 14.8* |
| Δ | — | 0.10 | 0.5 | 0.8 |
| % Δ | — | 0.71 | 3.6 | 5.7 |
| Left Humerus length (mm) | 12.2 | 12.4 | 12.5* | 12.9* |
| Δ | — | 0.2 | 0.3 | 0.7 |
| % Δ | — | 1.6 | 2.5 | 5.7 |
| Naso-anal length (mm, X-Ray) | 108 | 115* | 118* | 122* |
| Δ | — | 7.0 | 10 | 14 |
| % Δ | — | 6.5 | 9.3 | 13 |
| Crown-rump length in vivo (mm) | 94.9 | 99.1 | 102* | 107* |
| Δ | — | 4.2 | 7.1 | 12.1 |
| % Δ | — | 4.4 | 7.5 | 12.7 |
| Total CTL[b] segments (mm, X-Ray) | 50.5 | 55.0* | 56.7* | 59.5* |
| Δ | — | 4.5 | 6.2 | 9.0 |
| % Δ | — | 8.9 | 12.3 | 17.8 |
| Cervical segment (mm, X-Ray) | 8.27 | 9.00 | 9.41* | 9.95* |
| Δ | — | 0.73 | 1.14 | 1.68 |
| % Δ | — | 8.8 | 13.8 | 20.3 |
| Thoracic segment (mm, X-Ray) | 22.9 | 25.5* | 26.2* | 27.7* |
| Δ | — | 2.6 | 3.3 | 4.8 |
| % Δ | — | 11.4 | 14.4 | 21.0 |
| Lumbar segment (mm, X-Ray) | 19.3 | 20.5* | 21.1* | 21.9* |
| Δ | — | 1.2 | 1.8 | 2.6 |
| % Δ | — | 6.2 | 9.3 | 13.5 |
| Tail length in vivo (mm) | 96.1 | 102 | 106* | 112* |
| Δ | — | 5.9 | 9.9 | 15.9 |
| % Δ | — | 6.1 | 10.3 | 16.5 |
| Sternum length (mm, X-Ray) | 36.0 | 38.5* | 39.9* | 40.5* |
| Δ | — | 2.5 | 3.9 | 4.5 |
| % Δ | — | 6.9 | 10.8 | 12.5 |
| Metatarsal bone (3rd digit) (mm, X-Ray) | 23.3 | 24.5* | 24.8* | 26.1* |
| Δ | — | 1.2 | 1.5 | 2.8 |
| % Δ | — | 5.2 | 6.4 | 12.0 |
| Foramen magnum height (mm) | 4.08 | 4.13 | 4.12 | 4.17 |
| Δ | — | 0.05 | 0.04 | 0.09 |
| % Δ | — | 1.2 | 0.98 | 2.2 |
| Foramen magnum width (mm) | 4.66 | 4.72 | 4.73 | 4.72 |
| Δ | — | 0.06 | 0.07 | 0.06 |
| % Δ | — | 1.3 | 1.5 | 1.3 |
| Occipital-front distance (mm, X-Ray) | 42.3 | 42.9 | 42.8 | 43.2* |
| Δ | — | 0.6 | 0.5 | 0.9 |
| % Δ | — | 1.4 | 1.2 | 2.1 |
| Circularity index (mm, X-Ray) | 0.377 | 0.370 | 0.362 | 0.349* |
| Δ | — | −0.007 | −0.015 | −0.028 |
| % Δ | — | −1.9 | −4.0 | −7.4 |

[a] Δ and % Δ compared to Vehicle
[b] Cervical, thoracic, and lumbar
*Significant compared with Vehicle, P < 0.05

For in vivo measurements, NC2st-treated mice showed significantly longer crown-rump, tail, and tibia lengths in a dose-dependent manner compared to Vehicle. For both crown-rump and tail lengths, significant differences were reached after 2 weeks of treatment with both Tx-30 and Tx-100. Tibia length was significantly different versus Vehicle after 2 weeks (Tx-100) or 4 weeks (Tx-30) of treatment.

After 5 weeks of treatment, dose-dependent elongation of long bones was observed in NC2st-treated mice. In the Tx-100 group, significant bone growth was observed in the femur (10%), tibia (7%), ulna, and humerus (6%). In addition, body lengths (naso-anal) were statistically longer for Tx-10, Tx-30, and Tx-100 treated mice and reached 7%, 9%, and 13% increase, respectively. Spine segments (cervical-thoracic-lumbar) lengths were statistically longer at all doses (except cervical lengths for Tx-10). Metatarsal bone (3rd digit) lengths were statistically increased at all doses in a dose-dependent manner. Skull circularity decreased in a dose-dependent manner, and the occipital-front distance was statistically increased in Tx-100. Sternum lengths were statistically increased at all doses in a dose-dependent manner.

Data are provided for treatment with NC2st in wild-type CD-1 mice (Table 13) and in mice models for achondroplasia (Table 7). These results show that an Fc-NP fusion provides efficacy in both wild-type mice and severe mouse models of disease. Taken together, these results demonstrate that an Fc-NP fusion, such as NC2st, is capable of promoting bone growth and elongation in a dose-dependent manner. Using the methods described herein, the efficacy of NP polypeptides and Fc-NP fusions can be evaluated (e.g., at 10 mg/kg, 30 mg/kg or 100 mg/kg doses) in healthy mice (e.g., to elongate bone) and in mice models for disease.

Example 15

Stability of CNP Variants

Numerous CNP variants were synthesized and tested for their susceptibility to peptidase degradation by neutral endopeptidase (NEP), a known CNP degrading pathway in vivo. The sequences of the tested CNP variants are provided in FIG. 34 and described below.

NEP degradation was determined by the experiments performed under the following conditions. Generally, 100 µM of peptide was incubated at 37° C. in 500 µL total of buffer (100 mM Tris-C1, pH 7.5, 100 mM NaCl) containing 1.25 ng/µL of NEP. At various time points (0 min., 30 min., 60 min., 120 min., and 240 min.), 70 µL was taken from the tubes and heat inactivated at 100° C. for 10 minutes on the dry heat block. After centrifugation at 14,000 rpm for 5 minutes, 70 µL of the supernatant was transferred to HPLC tubes for 2×20 µL injections into RP-HPLC for analysis (Agilent XDB-C18). Area under curves of peaks corresponding to CNP variants were measured and plotted as % of control.

In a first set of experiments, various CNP variants were tested to evaluate their sensitivity to NEP degradation. The variants tested were CNP22 (SEQ ID NO: 4); CNP variants having a D6 bone-targeting moiety, including D6-14AAlinker-CNP [C3] (SEQ ID NO: 147) and CNP-14AAlinker-D6 [C4] (SEQ ID NO: 148); CDNP-derived variants, including CNP-Nterm2 [C5] (SEQ ID NO: 150), CDNP-S3A4A5R6 [C13] (SEQ ID NO: 115), CDNP29-S3A4A5R6 [C14] (SEQ ID NO: 151), C2(E6) [BC2] (SEQ ID NO: 130), and C3 (E6) [BC3] (SEQ ID NO: 131); and a CNP variant having a generic cathepsin cleavage sequence, including KB1(E6) (SEQ ID NO: 155), and as shown in FIG. 34. Results are shown in FIG. 35A and in Table 14.

Overall, these results show that C4 peptides showed sensitivity to NEP degradation in vitro. Nevertheless, they are more resistant than CNP22 since 75% of C4 were still intact after 240 minutes incubation with NEP.

TABLE 14

| Peptides | % of control after 240 min |
| --- | --- |
| CNP22 | 0 |
| D6-14AAlinker-CNP [C3] | 101 |
| CNP-14AAlinker-D6 [C4] | 75 |
| CNP-Nterm2 [C5] | 106 |
| CDNP-S3A4A5R6 [C13] | 100 |

TABLE 14-continued

| Peptides | % of control after 240 min |
| --- | --- |
| CDNP29-S3A4A5R6 [C14] | 99 |
| KB1(E6) | 107 |
| C2(E6) [BC2] | 101 |
| C3(E6) [BC3] | 100 |

Figure 35B:
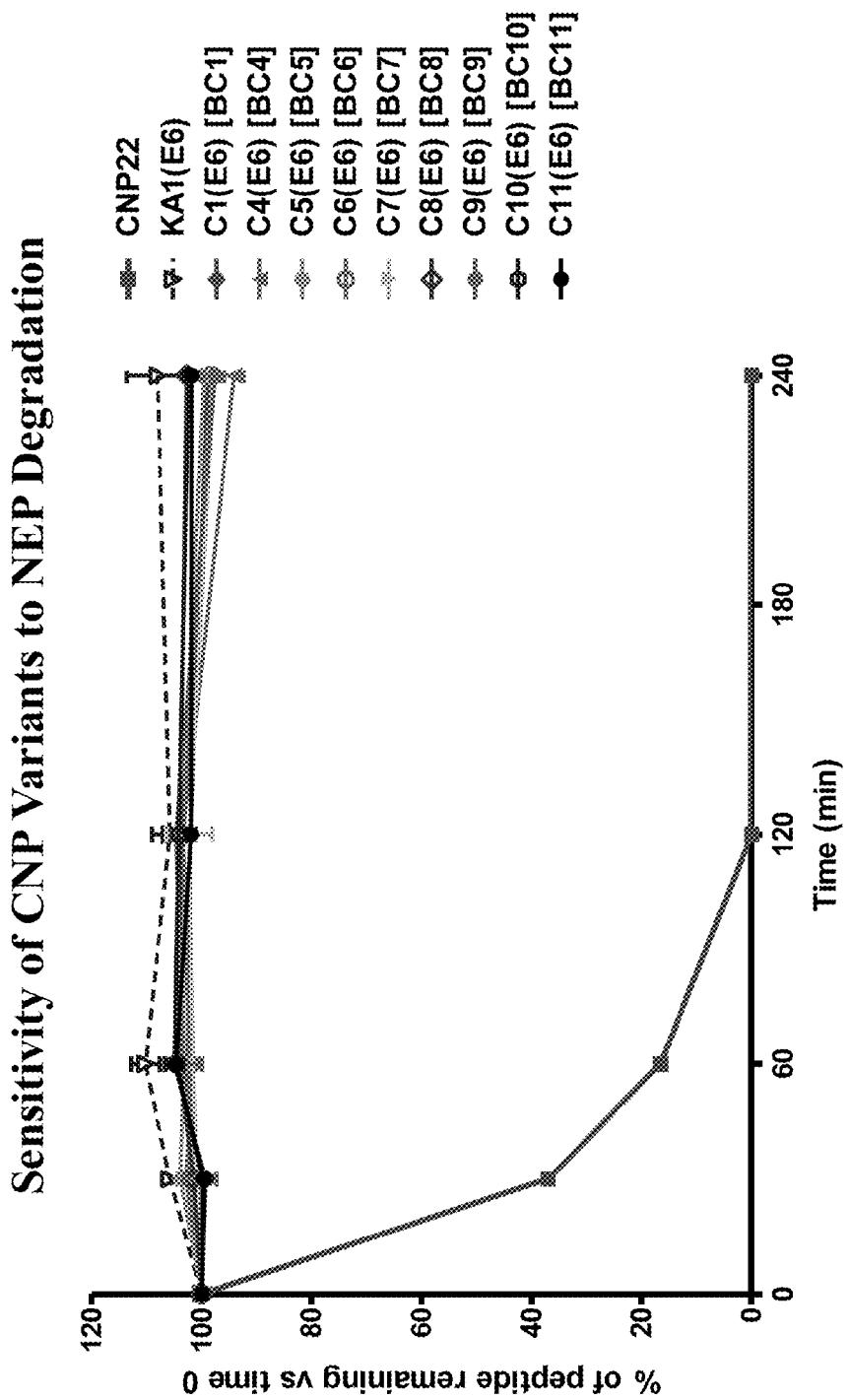
FIG. 35B is a graph showing the results of NEP degradation assays for CNP22, KA1(E6), C1(E6), and C4(E6)-C11(E6), where these sequences are shown in FIG. 34.

In a second set of experiments, various CNP variants having an E6 bone-targeting moiety were tested to evaluate their sensitivity to NEP degradation. The variants tested were CNP22 (SEQ ID NO: 4), as control; a CNP variant having a specific cathepsin K cleavage sequence, including KA1(E6) (SEQ ID NO: 153); and CNP variants having an E6 bone-targeting moiety and a $(Gly)_p[(Ser)(Gly)_m]_n$ linker, including C1(E6) and C4(E6) to C11(E6) [BC1 and BC4 to BC11] (SEQ ID NOs: 129 and 132-139), and as shown in FIG. 34. Results are shown in FIG. 35B and in Table 15. These results show that, in the conditions of this assay, all the tested CNP variants were completely resistant to NEP degradation in vitro.

TABLE 15

| Peptides | % of control after 240 min |
| --- | --- |
| CNP22 | 0 |
| KA1(E6) | 108 |
| C1(E6) [BC1] | 99 |
| C4(E6) [BC4] | 94 |
| C5(E6) [BC5] | 100 |
| C6(E6) [BC6] | 98 |
| C7(E6) [BC7] | 98 |
| C8(E6) [BC8] | 103 |
| C9(E6) [BC9] | 98 |
| C10(E6) [BC10] | 102 |
| C11(E6) [BC11] | 102 |

Example 16

Potency of CNP Variants

To determine potency, peptides were tested for their ability to generate cGMP in a NPR-B whole cell dose response assay. Various peptides having a bone-targeting moiety were tested for potency using a whole cell cGMP assay, as described above in Example 2. These results are shown in Table 16. The rescue ratio is defined as the agonist concentration needed to produce cGMP at the same level as 2.4 nM of CNP22 (lower value) and 14 nM of CNP22 (high value).

TABLE 16

| Peptide | N | Resist NEP degradation (No/Yes) | $EC_{50}$ (nM) | $EC_{50}$ Ratio versus CNP22 | % Efficacy | Rescue range (nM) | Rescue Ratio versus CNP22 | Rescue Ratio Average |
| --- | --- | --- | --- | --- | --- | --- | --- | --- |
| CNP22 | 8 | No | 14.7 ± 3.4 | 1.00 | 100 | 2.4-14 | 1 | 1 |
| KB1(E6) | 1 | Yes | 84.51 | 5.75 | 109 | 13.4-78.1 | 5.6-5.6 | 5.6 |
| KA1(E6) | 2 | Yes | 143.85 | 9.79 | 108 | 21.6-102 | 9.0-7.3 | 8.2 |
| C4(E6) [BC4] | 1 | Yes | 302 | 20.5 | 136 | 46-219 | 19-16 | 18 |
| C8(E6) [BC8] | 1 | Yes | 719 | 48.9 | 97 | 116-779 | 48-56 | 52 |
| C6(E6) [BC6] | 1 | Yes | 672.3 | 45.7 | 88 | 132-973 | 55-70 | 63 |
| C7(E6) [BC7] | 1 | Yes | 1009 | 68.6 | 95 | 177-1193 | 74-85 | 80 |
| C9(E6) [BC9] | 1 | Yes | 1166 | 79.3 | 95 | 183-1358 | 76-97 | 87 |
| C10(E6) [BC10] | 1 | Yes | 2474 | 168 | 156 | 213-1253 | 89-90 | 90 |
| C11(E6) [BC11] | 1 | Yes | 888.3 | 60.4 | 95 | 289-1662 | 120-119 | 120 |
| C1(E6) [BC1] | 1 | Yes | 1737 | 118 | 97 | 289-1733 | 120-124 | 122 |
| C5(E6) [BC5] | 1 | Yes | 2364 | 161 | 96 | 334-1899 | 139-136 | 138 |
| C3(E6) [BC3] | 1 | Yes | 990.1 | 67.4 | 67 | 280-3927 | 117-281 | 199 |

TABLE 16-continued

| Peptide | N | Resist NEP degradation (No/Yes) | EC$_{50}$ (nM) | EC$_{50}$ Ratio versus CNP22 | % Efficacy | Rescue range (nM) | Rescue Ratio versus CNP22 | Rescue Ratio Average |
|---|---|---|---|---|---|---|---|---|
| CNP-14AA linker-D6 [C4] | 1 | Yes | 2144 | 146 | 156 | 900-10000 | 375-714 | 545 |
| C2(E6) [BC2] | 1 | Yes | 719.8 | 49.0 | 97 | 424-20000 | 177-1429 | 803 |

As can be seen from these results, potency was improved by introducing a cathepsin cleavage site between the E6 moiety and CNP. For example, KA1(E6) and KB1(E6) are more potent than the other tested peptides, where KA1(E6) has a specific cathepsin K cleavage site and KB1(E6) has a general cathepsin cleavage site. Inclusion of the KGANKK sequence, or a variant thereof, can improve potency.

Example 17

Stability and Potency of NC2st Variants

NC2st variants may be varied in several respects, as described herein and in Example 6, while maintaining stability and potency. Naturally-occurring homologs of CNP are cleaved by neutral endopeptidase enzyme (NEP) and insulin degrading enzyme (IDE) in a cellular environment. Degradation by one of these enzymes could result in inactivating the ability of the natriuretic peptide to raise intracellular cGMP. Accordingly, various NC2st variants (FcCNP fusion proteins) were tested for their stability by determining cGMP generation after exposure to NEP or IDE.

The following variants were tested for stability with NEP or IDE: NC2-KGANKK (SEQ ID NO: 512), NC2B-L17 (SEQ ID NO: 530, where X is L), and NC2-KGANKK-L17 (SEQ ID NO: 572, NC2-KL), where CNP22 is provided as a control.

To evaluate stability of fusion proteins compared to CNP22, the following protocol was used for both neutral endopeptidase enzyme (NEP) and insulin degrading enzyme (IDE) assays. For the NEP assay, equimolar amounts of fusion proteins (60 μM) and CNP22 (120 μM) were incubated for 0, 30, or 120 min. at 37° C. with 1.25 ng/μL of purified NEP (R&D Systems) in an assay buffer (25 mM sodium phosphate, 150 mM NaCl, pH 7.4) in eppendorf tubes. For the IDE assay, equimolar amounts of fusion proteins (60 μM) and CNP22 (120 μM) were incubated for 0, 30, or 120 min. at 37° C. with 3 ng/μL of purified IDE (R&D Systems) in an assay buffer (25 mM sodium phosphate, 150 mM NaCl, pH 7.4) in eppendorf tubes. Following incubation, the tubes were placed on ice. Samples were then tested for their ability to activate cyclic GMP production through NPRB activation. HEK293 cells stably expressing human NPRB receptor were incubated with equally potent doses of CNP22, NC2-KGANKK, or NC2-KL (10 nM), or NC2B-L17 (300 nM) from each sample for 40 minutes. cGMP production was measured using a cGMP HTRF assay (Cisbio bioassays). Assay was performed in triplicate, and measured cGMP values were similar for all control samples.

Figure 36A:
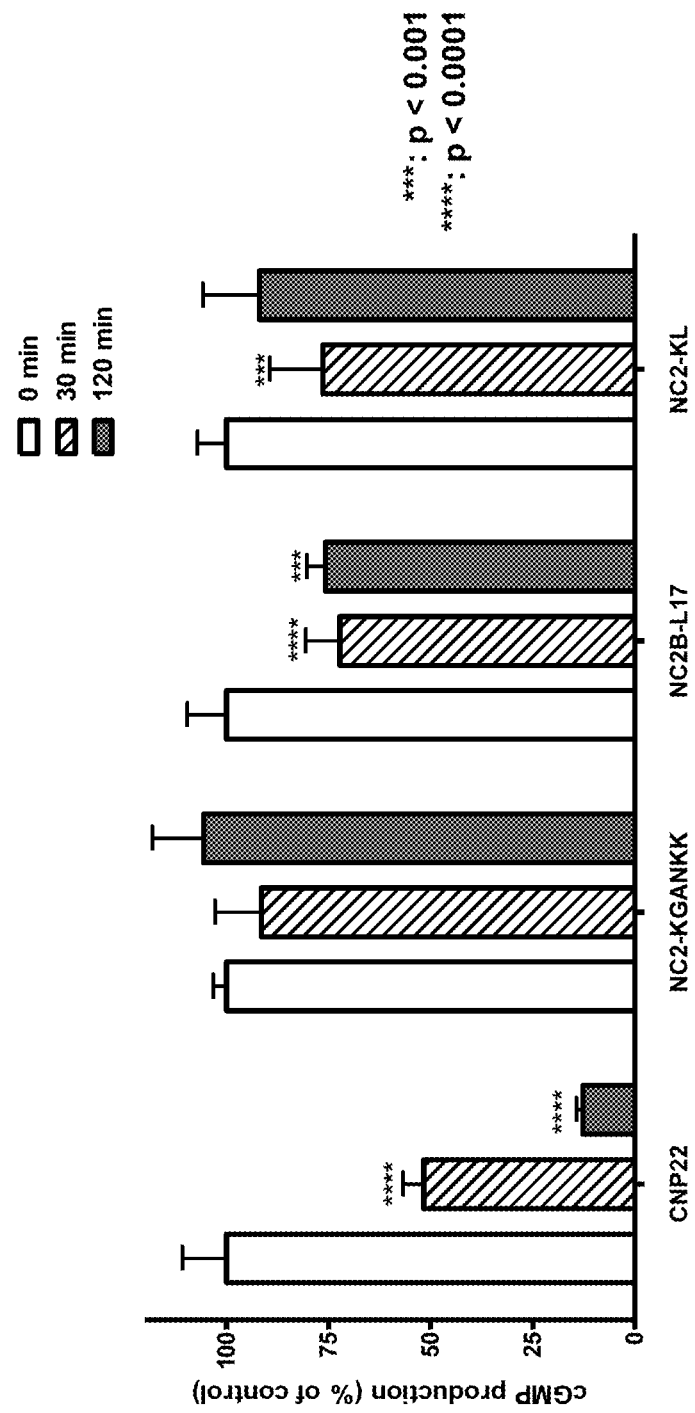
FIG. 36A is a graph showing the result of NEP degradation assays for CNP22, NC2-KGANKK, NC2B-L17, and NC2-KGANKK-L17 (NC2-KL).

As shown in FIG. 36A for NEP, incubation of CNP22 with purified NEP for 30 min. and 120 min. reduced its ability to generate cGMP by 50% and 87%, respectively. In contrast, NC2-KGANKK and NC2-KL still generated comparable levels of cGMP, even when incubated for 2 hours with NEP. NC2B-L 17 was slightly affected by incubation with NEP, reducing its ability to generate cGMP by 25%.

Figure 36B:
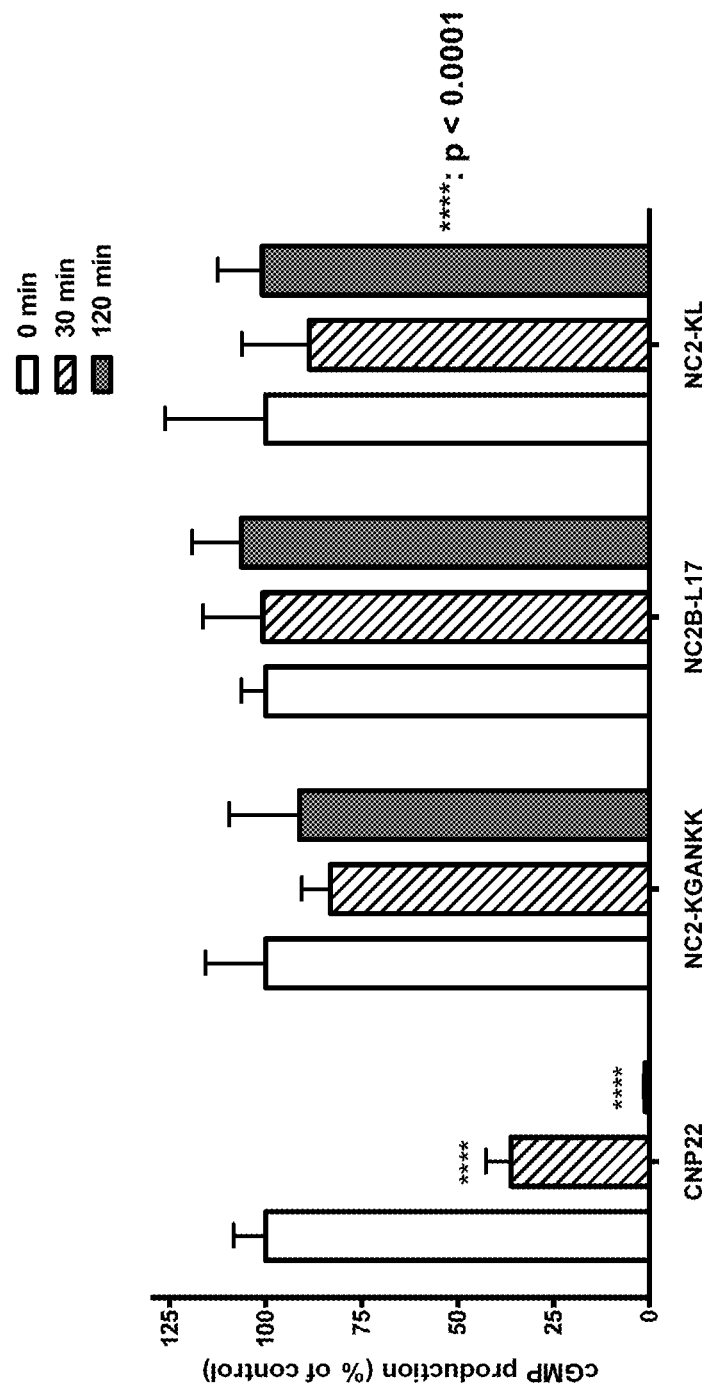
FIG. 36B is a graph showing the result of IDE degradation assays for CNP22, NC2-KGANKK, NC2B-L17, and NC2-KGANKK-L17 (NC2-KL).

As shown in FIG. 36B for IDE, incubation of CNP22 with purified IDE for 30 min. and 120 min. reduced its ability to generate cGMP by 64% and 99%, respectively. In contrast, all three FcCNP fusion proteins still generated comparable levels of cGMP even when incubated for 2 hours with IDE.

Taken together, these data for degradation studies suggest that FcCNP proteins are poor substrates for NEP and IDE, and may explain, at least in part, why these fusion proteins have highly increased half-lives in vivo compared to CNP22.

Figure 37A:
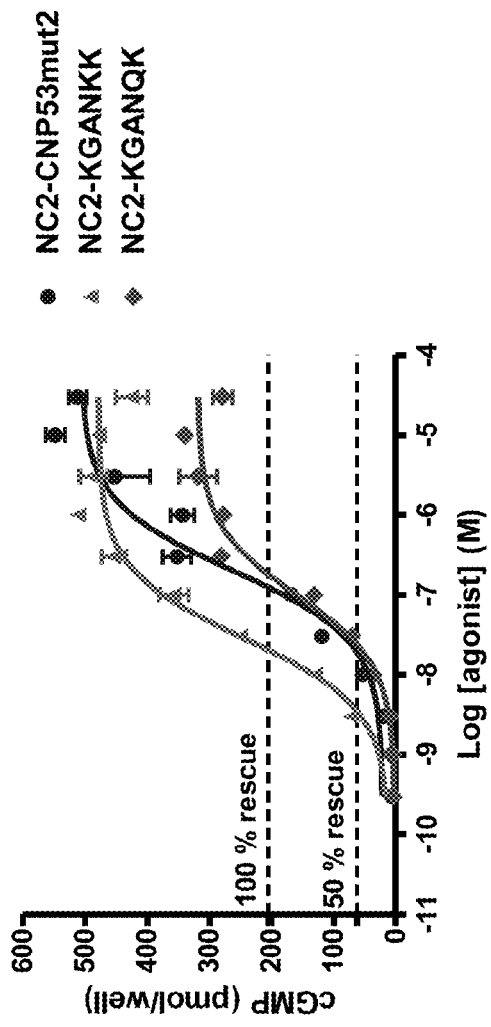
FIG. 37A is a set of dose-response curves for NC2-CNP53mut2, NC2-KGANKK, and NC2-KGANQK in an NPR-B whole cell assay, together with a table showing $EC_{50}$ values, $EC_{50}$ ratios relative to CNP22, % efficacy, and rescue range with rescue ratio relative to CNP22.

NC2st variants shown in FIG. 18 (NC2-KGANKK (SEQ ID NO:512) and NC2-KGANQK (SEQ ID NO: 514), without signal sequences) were tested for potency using a whole cell cGMP assay, as described above in Example 2. As provided in FIG. 37A, the results show that NC2-CNP53mut2, NC2-KGANKK, and NC2-KGANQK have improved potency compared to NC2B (SEQ ID NO: 504, as shown in FIG. 15A). In particular, NC2-KGANKK is the most potent of all the proteins provided in FIG. 37A.

Figure 37B:
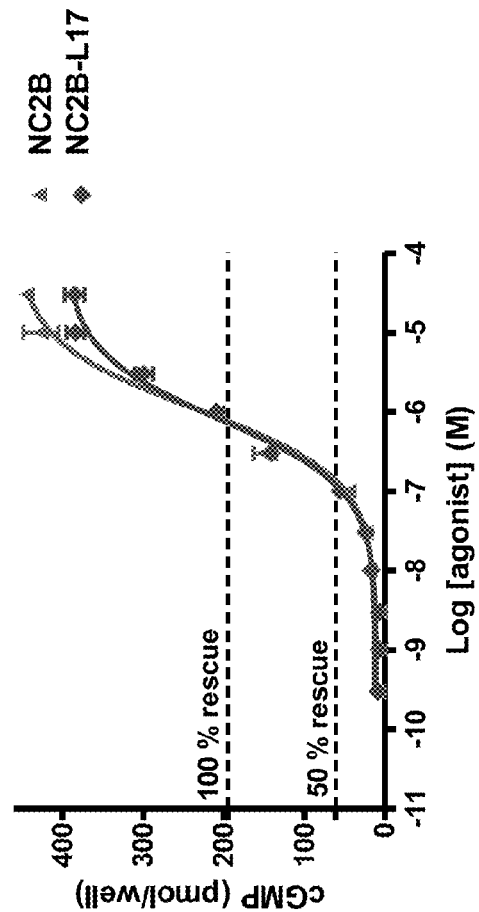
FIG. 37B is a set of dose-response curves for NC2B, and NC2B-L17 in an NPR-B whole cell assay, together with a table showing $EC_{50}$ values, $EC_{50}$ ratios relative to CNP22, % efficacy, and rescue range with rescue ratio relative to CNP22.

NC2st variants may also be varied by including point mutations of CNP22 at position 17. An NC2st variant having leucine at position 17 of CNP22, as shown in FIG. 41A (NC2B-L17 (SEQ ID NO: 530, where X is L), without a signal sequence) was tested for potency using a whole cell cGMP assay, as described above in Example 2. As provided in FIG. 37B, the results show that substitution of methionine for leucine at position 17 of CNP22 does not significantly reduce the potency of NPR-B activation, as compared to NC2B.

Additional data for NC2st variants without a signal sequence are provided below in Table 17, including NC2B (SEQ ID NO: 504); a peptide having a bone-targeting moiety, i.e., D10-NC2 (SEQ ID NO: 608); NC2B peptides having a point mutation at position 17 of CNP22, i.e., NC2B-L17, NC2B-F17, NC2B-I17, and NC2B-T17 (SEQ ID NO: 530, where X is L, F, I, or T, respectively); variants NC2-KGANKK and NC2-KGANQK (SEQ ID NOs: 512 and 514, respectively); and NC2-CNP53mut2 (SEQ ID NO: 516). The rescue ratio is defined as the agonist concentration needed to produce cGMP at the same level as 2.4 nM of CNP22 (lower value) and 14 nM of CNP22 (high value). The X in "rescue range" indicates that the dose at which the agonist can induce a cGMP production similar to 14 nM CNP22 cannot be determined because the agonist produced less cGMP.

TABLE 17

| Proteins | N | EC$_{50}$ (nM) | EC$_{50}$ Ratio versus CNP22 | % Efficiency | Rescue range (nM) | Rescue Ratio versus CNP22 |
|---|---|---|---|---|---|---|
| NC2B | 8 | 818 | 55.7 | 88 | 187-1134 | 79 ± 22 |
| D10-NC2 | 7 | 782 | 53.2 | 80 | 157-1023 | 69 ± 23 |
| NC2B-L17 | 2 | 1015 | 69.1 | 111 | 133-805 | 57 ± 6.8 |
| NC2B-F17 | 1 | 407 | 27.7 | 48 | 379-X | 156 |
| NC2B-I17 | 1 | 2844 | 194 | 110 | 395-2305 | 165 |
| NC2B-T17 | 1 | 1608 | 109 | 62 | 918-X | 383 |
| NC2-KGANKK | 4 | 29 | 1.97 | 115 | 4.8-29 | 2.0 ± 0.8 |

TABLE 17-continued

| Proteins | N | EC$_{50}$ (nM) | EC$_{50}$ Ratio versus CNP22 | % Efficiency | Rescue range (nM) | Rescue Ratio versus CNP22 |
|---|---|---|---|---|---|---|
| NC2-CNP53mut2 | 2 | 170 | 11.6 | 116 | 18-118 | 7.9 ± 0.8 |
| NC2-KGANQK | 3 | 167 | 11.4 | 98 | 29-187 | 13 ± 2.4 |

Accordingly, any of the sequences described herein can be modified to include KGANKK (SEQ ID NO: 314) or a variant thereof (e.g., KGANQK (SEQ ID NO: 315), KGANKQ (SEQ ID NO: 316), KGANQQ (SEQ ID NO: 317), QGANKK (SEQ ID NO: 318), QGANQK (SEQ ID NO: 319), QGANKQ (SEQ ID NO: 320), or QGANQQ (SEQ ID NO: 321)) as N-terminal extensions, C-terminal extensions, and/or linkers for any of the NPs disclosed herein; to include a bone-targeting moiety, such as a series of consecutive Asp or Glu residues, e.g., $E_6$, $E_7$, $E_8$, $E_9$, $E_{10}$, $E_{11}$, $E_{12}$, $E_{13}$, $E_{14}$, $E_{15}$, $E_{16}$, $D_6$, $D_7$, $D_8$, $D_9$, $D_{10}$, $D_{11}$, $D_{12}$, $D_{13}$, $D_{14}$, $D_{15}$, or $D_{16}$; to include a linker comprising GGGDLQVDTQSQAAWAQLL QEHPNAQQYKGANKK (SEQ ID NO: 330) or a fragment thereof; and/or to include a point mutation at position 17 of CNP22, such as a mutation at position 17 from methionine to phenylalanine, leucine, isoleucine, threonine, cysteine, proline, or aspartic acid.

Example 18

Exemplary Point Mutations of CNP22 at Position 17

Variants of CNP22, or polypeptides containing same, may be designed having a point mutation at position 17 relative to CNP22. As described herein, e.g., in Examples 11 and 15, this mutation can impart stability against degradation by oxidation and/or NEP cleavage without substantially reducing potency or efficacy. Further modifications include a variant having a bone-targeting moiety and variants having both a bone-targeting moiety and a linker, e.g., a flexible linker, between the bone-targeting moiety and the NP, where exemplary bone-targeting moieties and linkers are described herein.

Exemplary CNP variants having a point mutation at position 17 are shown in FIG. 38 (SEQ ID NOs: 126, 119-122, and 156-172), where X in SEQ ID NOs: 126 or 162 can be any amino acid, e.g., F, L, I, T, E, R, Y, C, P, or D. For example, in one embodiment of any of the sequences shown in FIG. 38, X is phenylalanine (Phe, F). In one embodiment of any of the sequences shown in FIG. 38, X is leucine (Leu, L). In one embodiment of any of the sequences shown in FIG. 38, X is isoleucine (Ile, I). In one embodiment of any of the sequences shown in FIG. 38, X is threonine (Thr, T). In one embodiment of any of the sequences shown in FIG. 38, X is glutamic acid (Glu, E). In one embodiment of any of the sequences shown in FIG. 38, X is arginine (Arg, R). In one embodiment of any of the sequences shown in FIG. 38, X is tyrosine (Tyr, Y). In one embodiment of any of the sequences shown in FIG. 38, X is cysteine (Cys, C). In one embodiment of any of the sequences shown in FIG. 38, X is proline (Pro, P). In one embodiment of any of the sequences shown in FIG. 38, X is aspartic acid (Asp, D). In one embodiment of any of the sequences shown in FIG. 38, X is glycine (Gly, G). In one embodiment of any of the sequences shown in FIG. 38, X is alanine (Ala, A). In one embodiment of any of the sequences shown in FIG. 38, X is serine (Ser, S). In one embodiment of any of the sequences shown in FIG. 38, X is valine (Val, V). In one embodiment of any of the sequences shown in FIG. 38, X is tryptophan (Trp, W). In one embodiment of any of the sequences shown in FIG. 38, X is asparagine (Asn, N). In one embodiment of any of the sequences shown in FIG. 38, X is glutamine (Gln, Q). In one embodiment of any of the sequences shown in FIG. 38, X is histidine (His, H). In one embodiment of any of the sequences shown in FIG. 38, X is lysine (Lys, K).

Variants of the molecules shown in FIG. 38 or otherwise described herein may also be utilized, e.g., lacking the bone-targeting moiety, or containing a different bone-targeting moiety. For example, any of $E_6$, $E_7$, $E_8$, $E_9$, $E_{10}$, $E_{11}$, $E_{12}$, $E_{13}$, $E_{14}$, $E_{15}$, $E_{16}$, $D_6$, $D_7$, $D_8$, $D_9$, $D_{10}$, $D_{11}$, $D_{12}$, $D_{13}$, $D_{14}$, $D_{15}$, or $D_{16}$ may be used as a bone-targeting moiety. A linker, e.g., a flexible linker, may be included between the bone-targeting moiety and the NP. For example, FIGS. 39A-39B provide variants having a linker or both a bone-targeting moiety and a linker, where X in any one of SEQ ID NOs: 173-210 can be any amino acid, e.g., F, L, I, T, E, R, Y, C, P, or D. For example, in one embodiment of any of the sequences shown in FIGS. 39A-39B having a linker or both a bone-targeting moiety and a linker, X is phenylalanine (Phe, F). In one embodiment of any of the sequences shown in FIGS. 39A-39B having a linker or both a bone-targeting moiety and a linker, X is leucine (Leu, L). In one embodiment of any of the sequences shown in FIGS. 39A-39B having a linker or both a bone-targeting moiety and a linker, X is isoleucine (Ile, I). In one embodiment of any of the sequences shown in FIGS. 39A-39B having a linker or both a bone-targeting moiety and a linker, X is threonine (Thr, T). In one embodiment of any of the sequences shown in FIGS. 39A-39B having a linker or both a bone-targeting moiety and a linker, X is glutamic acid (Glu, E). In one embodiment of any of the sequences shown in FIGS. 39A-39B having a linker or both a bone-targeting moiety and a linker, X is arginine (Arg, R). In one embodiment of any of the sequences shown in FIGS. 39A-39B having a linker or both a bone-targeting moiety and a linker, X is tyrosine (Tyr, Y). In one embodiment of any of the sequences shown in FIGS. 39A-39B, X is cysteine (Cys, C). In one embodiment of any of the sequences shown in FIGS. 39A-39B having a linker or both a bone-targeting moiety and a linker, X is proline (Pro, P). In one embodiment of any of the sequences shown in FIGS. 39A-39B having a linker or both a bone-targeting moiety and a linker, X is aspartic acid (Asp, D). In one embodiment of any of the sequences shown in FIGS. 39A-39B having a linker or both a bone-targeting moiety and a linker, X is glycine (Gly, G). In one embodiment of any of the sequences shown in FIGS. 39A-39B having a linker or both a bone-targeting moiety and a linker, X is alanine (Ala, A). In one embodiment of any of the sequences shown in FIGS. 39A-39B having a linker or both a bone-targeting moiety and a linker, X is serine (Ser, S). In one embodiment of any of the sequences shown in FIGS. 39A-39B having a linker or both a bone-targeting moiety and a linker, X is valine (Val, V). In one embodiment of any of the sequences shown in FIGS. 39A-39B having a linker or both a bone-targeting moiety and a linker, X is tryptophan (Trp, W). In one embodiment of any of the sequences shown in FIGS. 39A-39B having a linker or both a bone-targeting moiety and a linker, X is asparagine (Asn, N). In one embodiment of any of the sequences shown in FIGS. 39A-39B having a linker or both a bone-targeting moiety and a linker, X is glutamine (Gln, Q). In one embodiment of any of the sequences shown in FIGS. 39A-39B having a linker or both a bone-targeting moiety and a linker, X is histidine (His, H). In one embodiment of any of the sequences shown in FIGS. 39A-39B having a linker or both a bone-targeting moiety and a linker, X is lysine (Lys, K).

In addition, FIG. 40 provides amino acid sequences for particular variants, where X in SEQ ID NOs: 186-198 is a leucine to provide the sequences in SEQ ID NOs: 221-233.

Any of the molecules shown in FIGS. 38, 39A-39B, and 40, with or without the bone-targeting moiety, may be fused to an Fc domain and may optionally further include a linker region between the Fc and NP, as disclosed herein. For example, a CNP variant with M17X mutation can be fused to an Fc domain, e.g., as shown in FIGS. 41A-41E, where X can be any amino acid, e.g., F, L, I, T, E, R, Y, C, P, or D. For example, in one embodiment of any of the sequences shown in FIGS. 41A-41E, X is phenylalanine (Phe, F). In one embodiment of any of the sequences shown in FIGS. 41A-41E, X is leucine (Leu, L). In one embodiment of any of the sequences shown in FIGS. 41A-41E, X is isoleucine (Ile, I). In one embodiment of any of the sequences shown in FIGS. 41A-41E, X is threonine (Thr, T). In one embodiment of any of the sequences shown in FIGS. 41A-41E, X is glutamic acid (Glu, E). In one embodiment of any of the sequences shown in FIGS. 41A-41E, X is arginine (Arg, R). In one embodiment of any of the sequences shown in FIGS. 41A-41E, X is tyrosine (Tyr, Y). In one embodiment of any of the sequences shown in FIGS. 41A-41E, X is cysteine (Cys, C). In one embodiment of any of the sequences shown in FIGS. 41A-41E, X is proline (Pro, P). In one embodiment of any of the sequences shown in FIGS. 41A-41E, X is aspartic acid (Asp, D). In one embodiment of any of the sequences shown in FIGS. 41A-41E, X is glycine (Gly, G). In one embodiment of any of the sequences shown in FIGS. 41A-41E, X is alanine (Ala, A). In one embodiment of any of the sequences shown in FIGS. 41A-41E, X is serine (Ser, S). In one embodiment of any of the sequences shown in FIGS. 41A-41E, X is valine (Val, V). In one embodiment of any of the sequences shown in FIGS. 41A-41E, X is tryptophan (Trp, W). In one embodiment of any of the sequences shown in FIGS. 41A-41E, X is asparagine (Asn, N). In one embodiment of any of the sequences shown in FIGS. 41A-41E, X is glutamine (Gln, Q). In one embodiment of any of the sequences shown in FIGS. 41A-41E, X is histidine (His, H). In one embodiment of any of the sequences shown in FIGS. 41A-41E, X is lysine (Lys, K).

In some embodiments, the sequence is SEQ ID NO: 530, and X is any amino acid described herein. In one embodiment, the sequence is SEQ ID NO: 530, and X is phenylalanine (Phe, F). In one embodiment, the sequence is SEQ ID NO: 530, and X is leucine (Leu, L). In one embodiment, the sequence is SEQ ID NO: 530, and X is isoleucine (Ile, I). In one embodiment, the sequence is SEQ ID NO: 530, and X is threonine (Thr, T). In one embodiment, the sequence is SEQ ID NO: 530, and X is glutamic acid (Glu, E). In one embodiment, the sequence is SEQ ID NO: 530, and X is arginine (Arg, R). In one embodiment, the sequence is SEQ ID NO: 530, and X is tyrosine (Tyr, Y). In one embodiment, the sequence is SEQ ID NO: 530, and X is cysteine (Cys, C). In one embodiment, the sequence is SEQ ID NO: 530, and X is proline (Pro, P). In one embodiment, the sequence is SEQ ID NO: 530, and X is aspartic acid (Asp, D). In one embodiment, the sequence is SEQ ID NO: 530, and X is glycine (Gly, G). In one embodiment, the sequence is SEQ ID NO: 530, and X is alanine (Ala, A). In one embodiment, the sequence is SEQ ID NO: 530, and X is serine (Ser, S). In one embodiment, the sequence is SEQ ID NO: 530, and X is valine (Val, V). In one embodiment, the sequence is SEQ ID NO: 530, and X is tryptophan (Trp, W). In one embodiment, the sequence is SEQ ID NO: 530, and X is asparagine (Asn, N). In one embodiment, the sequence is SEQ ID NO: 530, and X is glutamine (Gln, Q). In one embodiment, the sequence is SEQ ID NO: 530, and X is histidine (His, H). In one embodiment, the sequence is SEQ ID NO: 530, and X is lysine (Lys, K).

Example 19

Exemplary NC2B Variants

NC2B may be varied in several respects, including having a point mutation, e.g., at position 17 relative to CNP22, having a bone-targeting moiety, and/or having modified or altered linker regions. Exemplary variants are provided below.

As shown in FIG. 42A and described above in Example 6, variants include those having modified or altered linker region, as compared to NC2B (as shown in FIGS. 15A-15B). In addition, variants also include any sequences having a bone-targeting moiety, e.g., a $D_{10}$ moiety, and exemplary sequences are provided in FIG. 42B (SEQ ID NOs: 553-558). In addition, the italicized regions in FIGS. 38, 39A-39B, and 40 may be used as N-terminal extensions, C-terminal extensions, and/or linkers for any of the NPs disclosed herein (e.g., SEQ ID NOs: 511-516 and 553-558). Any of SEQ ID NOs: 511-516 and 553-558 can be used in a method to treat any condition herein. In particular embodiments, one or more of SEQ ID NOs: 511-516 and 553-558 are used in a method to treat achondroplasia.

As shown in FIG. 42C, position 17 relative to CNP22 is substituted with a phenylalanine (Phe, F) in SEQ ID NOs: 537-542 to provide the sequences in SEQ ID NOs: 559-564. As shown in FIG. 42D, these sequences can be further modified to include a $D_{10}$ bone-targeting moiety at the N-terminus to provide the sequences in SEQ ID NOs: 565-570. In addition, the italicized regions in FIGS. 38, 39A-39B, and 40 may be used as N-terminal extensions, C-terminal extensions, and/or linkers for any of the NPs disclosed herein (e.g., SEQ ID NOs: 559-570). Any of SEQ ID NOs: 559-570 can be used in a method to treat any condition herein. In particular embodiments, one or more of SEQ ID NOs: 559-570 are used in a method to treat achondroplasia.

As shown in FIG. 42E, position 17 relative to CNP22 is substituted with a leucine (Leu, L) in SEQ ID NOs: 537-542 to provide the sequences in SEQ ID NOs: 571-576. As shown in FIG. 42F, these sequences can be further modified to include a $D_{10}$ bone-targeting moiety at the N-terminus to provide the sequences in SEQ ID NOs: 577-582. In addition, the italicized regions in FIGS. 38, 39A-39B, and 40 may be used as N-terminal extensions, C-terminal extensions, and/or linkers for any of the NPs disclosed herein (e.g., SEQ ID NOs: 571-582). Any of SEQ ID NOs: 571-582 can be used in a method to treat any condition herein. In particular embodiments, one or more of SEQ ID NOs: 571-582 are used in a method to treat achondroplasia.

As shown in FIG. 42G, position 17 relative to CNP22 is substituted with a arginine (Arg, R) in SEQ ID NOs: 537-542 to provide the sequences in SEQ ID NOs: 583-588. As shown in FIG. 42H, these sequences can be further modified to include a $D_{10}$ bone-targeting moiety at the N-terminus to provide the sequences in SEQ ID NOs: 589-594. In addition, the italicized regions in FIGS. 38, 39A-39B, and 40 may be used as N-terminal extensions, C-terminal extensions, and/or linkers for any of the NPs disclosed herein (e.g., SEQ ID NOs: 583-594). Any of SEQ ID NOs: 583-594 can be used in a method to treat any condition herein. In particular embodiments, one or more of SEQ ID NOs: 583-594 are used in a method to treat achondroplasia.

As shown in FIG. 42I, position 17 relative to CNP22 is substituted with a tyrosine (Tyr, Y) in SEQ ID NOs: 537-542 to provide the sequences in SEQ ID NOs: 595-600. As shown in FIG. 42J, these sequences can be further modified to include a $D_{10}$ bone-targeting moiety at the N-terminus to provide the sequences in SEQ ID NOs: 601-606. In addition, the italicized regions in FIGS. 38, 39A-39B, and 40 may be used as N-terminal extensions, C-terminal extensions, and/or linkers for any of the NPs disclosed herein (e.g., SEQ ID NOs: 595-606). Any of SEQ ID NOs: 595-606 can be used in a method to treat any condition herein. In particular embodiments, one or more of SEQ ID NOs: 595-606 are used in a method to treat achondroplasia.

Example 20

Effects of NC2B on Arterial Blood Pressure in Mice

To determine potential side effects of the fusion protein, we assessed the hemodynamic effects of NC2B on systolic, diastolic, and mean arterial blood pressures before and after subcutaneous (SC) administration of NC2B in telemetrized conscious wild-type mice.

Doses ranged from 0 to 100 mg/kg and were selected with respect to in vivo effect on bone growth. Six male c57BL/6J mice aged between 12 and 13 weeks old were included in each treatment group. NC2B administration was performed subcutaneously, once a day over 5 consecutive days, in non-anesthetized mice. Arterial blood pressures were acquired via surgically-implanted pressure transducers, positioned in the left carotid artery. For each mouse, the average of arterial blood pressures 30 minutes prior to daily injection was recorded as the reference and subtracted from the values at other time points to obtain hemodynamic response. Telemetry data analysis was based on average change over the 5 consecutive injection days for each individual mice, since no signs of cumulative or additive effects nor any habituation or tolerance were observed following separate analysis of each injection day.

Figures 43A, 43B, 43C:
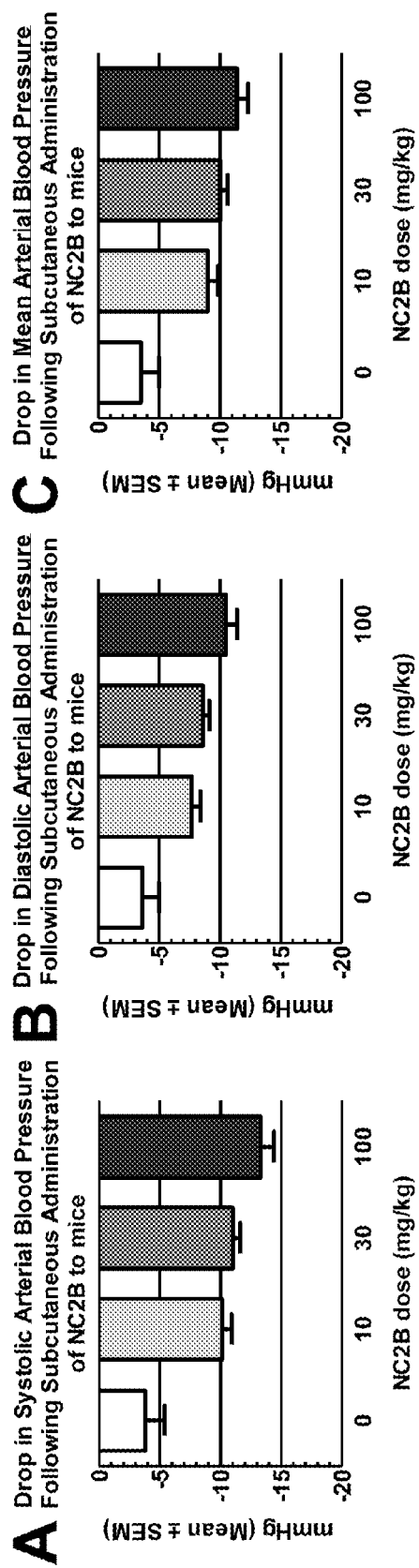
FIGS. 43A-43C show NC2B hemodynamic dose-response effects by providing average changes of systolic arterial blood pressure (A), diastolic arterial blood pressure (B), and mean arterial blood pressure (C) observed between 2 to 8 hours post-subcutaneous administration, relative to an average baseline obtained 30 minutes prior to injection. Analysis is based on average telemetry data pooled from the 5 consecutive injection days for each individual mice; n=6 per group.

As shown in FIGS. 43A-43C, NC2B induced hemodynamic effects and displayed a dose-response relationship when injected SC. These hypotensive effects are considered limited and within an acceptable hemodynamic range at all tested doses following SC administration. Accordingly, any of the sequences described herein can be assayed for possible dose-dependent side effects, such as adverse hemodynamic effects including lowering of blood pressure, and administered in a dosage range (e.g., any described herein) to minimize such side effects or to reduce these side effects, as compared to a control (e.g., any described herein).

Example 21

Evaluation of a Weekly Bolus Subcutaneous Injection of NC2B on Bone Growth in Wild-Type (Cd-1) Mice Objective The study was designed to evaluate the effect of weekly subcutaneous (SC) administration of NC2B on bone growth in wild-type (WT) mice.

Test Article

Test article: NC2B formulated in 25 mM sodium phosphate, 150 mM NaCl, pH 7.4.

Control article: Vehicle, 25 mM sodium phosphate, 150 mM NaCl, pH 7.4.

Test System

CD-1 mice are a standard rodent species for use in pharmacodynamic studies, and these mice are described above in Example 14.

Experimental Design

The animals received NC2B as a subcutaneous injection into the interscapular region as described in Table 18 below.

TABLE 18

| Group No. | Group description | ROA | Duration of treatment (days) | Dosing Interval | Dose Level (mg/kg) | Total amount received (mg/kg (nmol/kg)) | WT (CD-1, female) N = |
|---|---|---|---|---|---|---|---|
| 1 | V | SC injection | 35 | Once daily | 0 | 0 (0) | 16 |
| 2 | Tx-30-QD | SC injection | 35 | Once daily | 30 | 1,050 (18,235) | 16 |
| 3 | Tx-30-QW | SC injection | 35 | Once weekly | 30 | 150 (2,605) | 16 |
| 4 | Tx-100-QW | SC injection | 35 | Once weekly | 100 | 500 (8,690) | 16 |
| 5 | Tx-200-QW | SC injection | 35 | Once weekly | 200 | 1,000 (17,380) | 16 |
| 6 | Tx-100-5QD* | SC injection | 5 | Once daily | 100 | 500 (8,690) | 16 |

ROA: route of administration
*The dosing regimen for Tx-100-5QD was daily for 5 consecutive days (Day 1 to Day 5 of the study), followed by 30 days of recovery (Day 6 to Day 35). Necropsy followed on Day 36.

CD-1 mice were treated at 3 weeks old at the indicated doses for 35 consecutive days, followed by necropsy 24 hours after the last injection.

Experimental Procedures

Experiments were conducted as described above in Example 14.

Results

Experimental results are shown in FIGS. 44A-44B and are summarized in Table 19 (results at day 36) below. Data in Table 19 were obtained at necropsy with a caliper, unless otherwise noted.

TABLE 19

| Length measurement[a] | V | Tx-30-QD | Tx-30-QW | Tx-100-QW | Tx-200-QW | Tx-100-5QD |
|---|---|---|---|---|---|---|
| Left Tibia length (mm) | 17.8[#] | 18.7* | 18.4* | 18.3 | 18.5* | 18.4* |
| Δ | — | 0.9 | 0.6 | 0.5 | 0.7 | 0.6 |
| % Δ | — | 5.1 | 3.4 | 2.8 | 3.9 | 3.4 |
| Left Femur length (mm) | 15.0[#] | 16.2* | 15.6*[#] | 15.6*[#] | 15.8* | 15.3[#] |
| Δ | — | 1.2 | 0.6 | 0.6 | 0.8 | 0.3 |
| % Δ | — | 8.0 | 4.0 | 4.0 | 5.3 | 2.0 |
| Left Ulna length (mm) | 14.0[#] | 14.9* | 14.4 | 14.4 | 14.3[#] | 14.4 |
| Δ | — | 0.9 | 0.4 | 0.4 | 0.3 | 0.4 |
| % Δ | — | 6.4 | 2.9 | 2.9 | 2.1 | 2.9 |
| Left Humerus length (mm) | 12.2[#] | 12.8* | 12.6* | 12.6* | 12.6* | 12.4[#] |
| Δ | — | 0.6 | 0.4 | 0.4 | 0.4 | 0.2 |
| % Δ | — | 4.9 | 3.3 | 3.3 | 3.3 | 1.6 |
| Naso-anal length (mm, X-Ray) | 108[#] | 120* | 114*[#] | 115*[#] | 117* | 112[#] |
| Δ | — | 12 | 6.0 | 7.0 | 9.0 | 4.0 |
| % Δ | — | 11.1 | 5.6 | 6.5 | 8.3 | 3.7 |
| Crown-rump length in vivo (mm, ruler) | 97.9[#] | 106* | 103* | 103* | 104* | 101[#] |
| Δ | — | 8.1 | 5.1 | 5.1 | 6.1 | 3.1 |
| % Δ | — | 8.3 | 5.2 | 5.2 | 6.2 | 3.2 |
| Total CTL[b] segments (mm, X-Ray) | 51.0[#] | 57.9* | 54.4*[#] | 54.5*[#] | 55.9*[#] | 53.0*[#] |
| Δ | — | 6.9 | 3.4 | 3.5 | 4.9 | 2.0 |
| % Δ | — | 13.5 | 6.7 | 6.9 | 9.6 | 3.9 |
| Tail length in vivo (mm, ruler) | 99.1[#] | 109* | 104* | 104* | 107* | 104*[#] |
| Δ | — | 9.9 | 4.9 | 4.9 | 7.9 | 4.9 |
| % Δ | — | 10.0 | 4.9 | 4.9 | 8.0 | 4.9 |

[a]Δ and % Δ compared to Vehicle
[b]Cervical, thoracic, and lumbar
*Significant compared with Vehicle, $P < 0.05$
[#]Significant compared with Tx-30-QD, $P < 0.05$ Both NC2B daily and weekly therapeutic regimens induced robust growth of almost all bone lengths (axial and appendicular) after a 35-day treatment period in wild-type mice. As shown in Tables 13 and 19, NC2st and NC2B at 30 mg/kg daily have similar efficacy on bone growth in mice. These data confirm that a weekly dosing regimen is sufficient for Fc-CNP fusion protein to induce significant bone growth.

References

1. Potter, L. R., S. Abbey-Hosch, and D. M. Dickey, Natriuretic peptides, their receptors, and cyclic guanosine monophosphate-dependent signaling functions. Endocr Rev, 2006. 27(1): p. 47-72.
2. Hagiwara, H., et al., Autocrine regulation of rat chondrocyte proliferation by natriuretic peptide C and its receptor, natriuretic peptide receptor-B. J Biol Chem, 1994. 269(14): p. 10729-33.
3. Hagiwara, H., et al., cGMP produced in response to ANP and CNP regulates proliferation and differentiation of osteoblastic cells. Am J Physiol, 1996. 270(5 Pt 1): p. C1311-8.
4. Suda, M., et al., C-type natriuretic peptide as an autocrine/paracrine regulator of osteoblast. Evidence for possible presence of bone natriuretic peptide system. Biochem Biophys Res Commun, 1996. 223(1): p. 1-6.
5. Yasoda, A., et al., Natriuretic peptide regulation of endochondral ossification. Evidence for possible roles of the C-type natriuretic peptide/guanylyl cyclase-B pathway. J Biol Chem, 1998. 273(19): p. 11695-700.
6. Mericq, V., et al., Regulation of fetal rat bone growth by C-type natriuretic peptide and cGMP. Pediatr Res, 2000. 47(2): p. 189-93.
7. Daggubati, S., et al., Adrenomedullin, endothelin, neuropeptide Y, atrial, brain, and C-natriuretic prohormone peptides compared as early heart failure indicators. Cardiovasc Res, 1997. 36(2): p. 246-55.
8. Kalra, P. R., et al., The role of C-type natriuretic peptide in cardiovascular medicine. Eur Heart J, 2001. 22(12): p. 997-1007.
9. Pfeifer, A., et al., Intestinal secretory defects and dwarfism in mice lacking cGMP-dependent protein kinase II. Science, 1996. 274(5295): p. 2082-6.
10. Yasoda, A., et al., Overexpression of CNP in chondrocytes rescues achondroplasia through a MAPK-dependent pathway. Nat Med, 2004. 10(1): p. 80-6.
11. Chusho, H., et al., Dwarfism and early death in mice lacking C-type natriuretic peptide. Proc Natl Acad Sci USA, 2001. 98(7): p. 4016-21.
12. Yoder, A., et al., Reduced ability of C-type natriuretic peptide (CNP) to activate natriuretic peptide receptor B (NPR-B) causes dwarfism in lbab-/- mice. Peptides, 2008. 29(9): p. 1575-1581.
13. Bocciardi, R., et al., Overexpression of the C-type natriuretic peptide (CNP) is associated with overgrowth and bone anomalies in an individual with balanced t(2;7) translocation. Hum Mutat, 2007. 28(7): p. 724-31.
14. Tamura, N., et al., Critical roles of the guanylyl cyclase B receptor in endochondral ossification and development of female reproductive organs. Proc Natl Acad Sci USA, 2004. 101(49): p. 17300-5.
15. Tsuji, T. and T. Kunieda, A loss-of-function mutation in natriuretic peptide receptor 2 (Npr2) gene is responsible for disproportionate dwarfism in cn/cn mouse. J Biol Chem, 2005. 280(14): p. 14288-92.
16. Miyazawa, T., et al., Cyclic GMP-dependent protein kinase II plays a critical role in C-type natriuretic peptide-mediated endochondral ossification. Endocrinology, 2002. 143(9): p. 3604-10.
17. Teixeira, C., H. Agoston, and F. Beier, Nitric oxide, C-type natriuretic peptide and cGMP as regulators of endochondral ossification. Developmental Biology, 2008. 319(2): p. 171-178.
18. Horton, W. A., J. G. Hall, and J. T. Hecht, Achondroplasia. Lancet, 2007. 370(9582): p. 162-72.

19. Nakao, K., et al., The pharmacokinetics of alpha-human atrial natriuretic polypeptide in healthy subjects. Eur J Clin Pharmacol, 1986. 31(1): p. 101-3.

20. Brenner, B. M., et al., Diverse biological actions of atrial natriuretic peptide. Physiol Rev, 1990. 70(3): p. 665-99.

21. Farnum, C. E., et al., In vivo delivery of fluoresceinated dextrans to the murine growth plate: Imaging of three vascular routes by multiphoton microscopy. The Anatomical Record Part A: Discoveries in Molecular, Cellular, and Evolutionary Biology, 2006. 288A(1): p. 91-103.

22. Williams, R. M., et al., Solute transport in growth plate cartilage: In vitro and in vivo. Biophysical Journal, 2007. 93: 1039-1050.

23. Chen, L., et al., Gly369Cys mutation in mouse FGFR3 causes achondroplasia by affecting both chondrogenesis and osteogenesis, J Clin Invest, 1999. 104(11): 1517-1525.

24. Yasoda, A., et al., Systemic Administration of C-Type Natriuretic Peptide as a Novel Therapeutic Strategy for Skeletal Dysplasias, Endocrinology, 2009. 150(7): 3138-3144.

OTHER EMBODIMENTS

All publications, patent applications, and patents mentioned in this specification are herein incorporated by reference in their entirety.

While the invention has been described in connection with specific embodiments, it will be understood that it is capable of further modifications. Therefore, this application is intended to cover any variations, uses, or adaptations of the invention that follow, in general, the principles of the invention, including departures from the present disclosure that come within known or customary practice within the art.

SEQUENCE LISTING (1206 sequences)

SEQ ID NO: 1 - protein, 28 aa, Homo sapiens
SLRRSSCFGGRMDRIGAQSGLGCNSFRY

SEQ ID NO: 2 - protein, 32 aa, Homo sapiens
TAPRSLRRSSCFGGRMDRIGAQSGLGCNSFRY

SEQ ID NO: 3 - protein, 32 aa, Homo sapiens
SPKMVQGSGCFGRKMDRISSSSGLGCKVLRRH

SEQ ID NO: 4 - protein, 22 aa, Homo sapiens
GLSKGCFGLKLDRIGSMSGLGC

SEQ ID NO: 5 - protein, 38 aa, Dendroaspis angusticeps
EVKYDPCFGHKIDRINHVSNLGCPSLRDPRPNAPSTSA

SEQ ID NO: 6 - protein, 17 aa, Artificial Sequence
  CONSENSUS SEQUENCE
  MISC_FEATURE (4)..(6): Xaa can be any naturally occurring amino acid or any amino acid at the corresponding position in one of SEQ ID NOs: 1-5
  MISC_FEATURE (10)..(12): Xaa can be any naturally occurring amino acid or any amino acid at the corresponding position in one of SEQ ID NOs: 1-5
  MISC_FEATURE (14)..(14): Xaa can be any naturally occurring amino acid or any amino acid at the corresponding position in one of SEQ ID NOs: 1-5
CFGXXXDRIXXXSXLGC

SEQ ID NO: 7-10 - skipped (4 entries)

SEQ ID NO: 11 - protein, 53 aa, Homo sapiens
DLRVDTKSRAAWARLLQEHPNARKYKGANKKGLSKGCFGLKLDRIGSMSGLGC

SEQ ID NO: 12 - protein, 17 aa, Homo sapiens
CFGLKLDRIGSMSGLGC

SEQ ID NO: 13 - protein, 22 aa, Bos taurus
GLSKGCFGLKLDRIGSMSGLGC

SEQ ID NO: 14 - protein, 22 aa, Ovis aries
GLSKGCFGLKLDRIGSMSGLGC

SEQ ID NO: 15 - protein, 22 aa, Mus musculus
GLSKGCFGLKLDRIGSMSGLGC

SEQ ID NO: 16 - protein, 22 aa, Sus scrofa
GLSKGCFGLKLDRIGSMSGLGC

SEQ ID NO: 17 - protein, 27 aa, Micrurus fulvius fulvius
GLAKEALGDGCFGLKLDRIGTSSGLGC

SEQ ID NO: 18 - protein, 18 aa, Taeniopygia guttata
GCFGLKLDRIGTFSGLGC

SEQ ID NO: 19 - protein, 22 aa, Gallus gallus
GLSRSCFGVKLDRIGSMSGLGC

SEQ ID NO: 20 - protein, 20 aa, Rana catesbeiana
SRGCFGVKLDRIGAFSGLGC

SEQ ID NO: 21 - protein, 22 aa, Anguilla japonica
GWNRGCFGLKLDRIGSLSGLGC

SEQ ID NO: 22 - protein, 22 aa, Oncorhynchus mykiss
GWNRGCFGLKLDRIGSMSGLGC

SEQ ID NO: 23 - protein, 22 aa, Ornithorhynchus anatinus
GLSKGCFGLKLDRIGSTSGLGC

SEQ ID NO: 24 - protein, 19 aa, Trimeresurus flavoviridis
KGCFGHKLDRIGSTSGLGC

SEQ ID NO: 25 - protein, 20 aa, Polypterus endlicheri
SKGCFGLKLDRIGSISGLGC

SEQ ID NO: 26 - protein, 21 aa, Xenopus laevis
LSKGCFGLKLDRIGVVSGLGC

SEQ ID NO: 27 - protein, 18 aa, Oryzias latipes
GCFGMKMDRIGSISGLGC

SEQ ID NO: 28 - protein, 18 aa, Tetraodon nigroviridis
GCFGMKIDRIGSISGLGC

SEQ ID NO: 29 - protein, 23 aa, Pseudechis australis
SKIGDGCFGLPLDHIGSVSGLGC

SEQ ID NO: 30 - protein, 27 aa, Artificial Sequence
  CONSENSUS SEQUENCE
  MISC_FEATURE (1)..(10): Xaa can be any naturally occurring amino acid or any amino acid at the corresponding position in one of SEQ ID NOs: 4 and 13-29
  MISC_FEATURE (14)..(16): Xaa can be any naturally occurring amino acid or any amino acid at the corresponding position in one of SEQ ID NOs: 4 and 13-29
  MISC_FEATURE (18)..(18): Xaa can be any naturally occurring amino acid or any amino acid at the corresponding position in one of SEQ ID NOs: 4 and 13-29
  MISC_FEATURE (21)..(22): Xaa can be any naturally occurring amino acid or any amino acid at the corresponding position in one of SEQ ID NOs: 4 and 13-29
XXXXXXXXXXCFGXXXDXIGXXSGLGC

SEQ ID NO: 31 - protein, 126 aa, Oryzias latipes
MAVCSSSSLILLTVFLSVAVETRPSSDRDEEQVLKSLFGPHLTSLILAPPTSNDSTEGSSGSPEPPTPSEAPVLIHGDRGTASQILRSFLRQREKTRRWGRKPMVAGGGCFGMKMDRIGSISGLGC

SEQ ID NO: 32 - protein, 130 aa, Takifugu rubripes
MAASSSSFVPLVLLFLAIPVEPRPSMTRDEAQVLRALFGARLSSIISTPVNTDDIAELLPRRPGPPRSFGASPGALRGLTRGSEGGSRFLLDFLQQQSKTTRRGRSSMVGGRGCFGMKIDRIGSISGLGC

SEQ ID NO: 33 - protein, 150 aa, Acipenser transmontanus
MSISSSSSSSSSSSSCLLLISLMLLAASCQGRPDLQHRNHKSQLAGLFGAEVAALLEDAGAADGSSGEEAALSQRAPPSIRALHPRSGRLGLRDDLEAEPPAENKPRRRLLKDFMSSRKMFRGRTKKMQQGRGCFGMKLDRIGSMSGLGC

SEQ ID NO: 34 - protein, 126 aa, Mus musculus
MHLSQLIACALLLALLSLRPSEAKPGTPPKVPRTPPGEELADSQAAGGNQKKGDKTPGSGGANLKGDRSRLLRDLRVDTKSRAAWARLLHEHPNARKYKGGNKKGLSKGCFGLKLDRIGSMSGLGC

SEQ ID NO: 35 - protein, 126 aa, Mus musculus; identical to SEQ ID NO: 34

SEQ ID NO: 36 - protein, 147 aa, Notomys alexis
MHLSQLIACALLLALLSLRPSEAKPGTPPKVPRTPPGEELADSQAAGGNQKKGDKTPGGGGANLKGDRSRLLKGDKTPGGGGANLKGDRSRLLRDLRVDTKSRAAWARLLHEHPNARKNKGGNKKGLSKGCFGLKLDRIGSMSGLGC

SEQ ID NO: 37 - protein, 126 aa, Rattus norvegicus
MHLSQLIACALLLALLSLRPSEAKPGTPPKVPRTPPGEELAEPQAAGGNQKKGDKTPGGGGANLKGDRSRLLRDLRVDTKSRAAWARLLHEHPNARKYKGGNKKGLSKGCFGLKLDRIGSMSGLGC

SEQ ID NO: 38 - protein, 126 aa, Bos taurus
MHLSQLLACALLLALLSLRPSEAKPGAPPKVPRTPSGEEVAEPQAAGGGQKKGDKTPGGGGANLKDDRSRLLRDLRVDTKSRAAWTRLLHEHPNARKYKGGNKKGLSKGCFGLKLDRIGSMSGLGC

SEQ ID NO: 39 - protein, 126 aa, Ovis aries
MHLSQLLACALLLSLLSLRPSEAKPGAPPKVPRTPPGEEVAEPQAAGGGQKKGDKTPGGGGANLKDDRSRLLRDLRVDTKSRAAWTRLLHEHPNARKYKGGNKKGLSKGCFGLKLDRIGSMSGLGC

SEQ ID NO: 40 - protein, 126 aa, Sus scrofa
MHLSQLLACALLLTLLSLRPSEAKPGAPPKVPRTPPGEEVAEPQAAGGGQKKGDKTPGGGGANLKGDRSRLLRDLRVDTKSRAAWARLLHEHPNARKYKGGNKKGLSKGCFGLKLDRIGSMSGLGC

SEQ ID NO: 41 - protein, 126 aa, Homo sapiens
MHLSQLLACALLLTLLSLRPSEAKPGAPPKVPRTPPAEELAEPQAAGGGQKKGDKAPGGGGANLKGDRSRLLRDLRVDTKSRAAWARLLQEHPNARKYKGANKKGLSKGCFGLKLDRIGSMSGLGC

SEQ ID NO: 42 - protein, 121 aa, Ornithorhynchus anatinus
MHLSHLLAWALLLTLLSLRAEAKPPSPQPQVPRSPGDEASEAVAANGGGKKGDKEPKGDRPRLLRELRLDTRSRGSRGVWTRLLHDHPNPRKYKPANKKGLSKGCFGLKLDRIGSTSGLGC

SEQ ID NO: 43 - protein, 33 aa, Cavia porcellus
NARKYKGGNKKGLSKGCFGLKLDRIGSMSGLGC

SEQ ID NO: 44 - protein, 121 aa, Oryzias latipes
MNLSYLVACGLLVTFLSDKMDAQPLTPAQQKSLRSLLGEELAEFLESGENENRLDDVRSRMRLLRDLRVDTRARGMWARLLNDQPASRRHKSGSKKGGSTSRSGCFGHKMDRIGTISGMGC

SEQ ID NO: 45 - protein, 120 aa, Takifugu rubripes
MNLSYLVACGLMITLLSVRMGAKPLSQAQQKSFRSLLGEELAEFLESEEKERRLDAVRSRLRLLRDLRMDTRARGVWARLLNDQPVPRRHKTGIKKGGSSRSGCFGHKMDRIGTISGMGC

SEQ ID NO: 46 - protein, 121 aa, Esox lucius
MNISYLVACGLMITLLSVRSGAKPLTAAQQKSLRNLLGEELSEFLASGERERRLDTVRSRVRLLRDLRMDTRAKGMWARLLNDQPNARRHKQNSKKGTVPRSGCFGQKLDRIGTLSGMGCN

SEQ ID NO: 47 - protein, 120 aa, Anguilla japonica
MNVSQLMVCGLLMALFSFSTEAKSLIPAQEKSLRNLLGEELSEYLASGERERNLESARSRLLRDLRLNTRARGMWSRIMNDQPASRKQKTGVKKGASTPARGGCFGHKLDRISTLSGMGC

SEQ ID NO: 48 - protein, 118 aa, Actinopterygii
MNISHLVACGLLVALLTVTMEAKPLTQSQQKSLRNLLGEELSAYLTSDEQESGSENLRSRARLLRDLRLDIRAKAAWARLLNDHPNPRKSKGINKKGLSKGCFGLKLDRIGSMSGLGC

SEQ ID NO: 49 - protein, 118 aa, Rana catesbeiana
MHFCHIVGWGLVLAVLYLRTEAKPVAQAHQKSLRALLGEELAEYLVSGERGERSIDPKTRARLLRDIRADTRSRAAWTRLLNEHPNSRKIKGINKKGTSKGCFGLKLDRIGAMSGLGC

SEQ ID NO: 50 - protein, 193 aa, Trimeresurus flavoviridis
MFVSRLAASGLLLLALLALSLDGKPVHQSKPGRSPPISPLSAQQWMPEGRPPHPIPPLSVQQWSQGRPRSEVPPVVVQPHESPAGGTTAFREELSPGPEAASGPAAPHRLPKSKGASATSAASRPMRDLRTDGKQERQKWGRMVQPDHHAAPGGGGGGGGGARRMKGLAKKAMGKGCFGHKLDRIGSTSGLGC

SEQ ID NO: 51 - protein, 210 aa, Trimeresurus gramineus
MFVSRLAASGLLLLALLALSLDGKPVQEKPGRSPPISPLLVPPPPPPPHWPPPHHIPPLSVQKFPPGWKPTHPHHIPPLEVQQWSQGGPRSELVQPHESPAGGTTAFREELSLGPEAASGPAAPQRLPKRKGASATSAASRSMRDLRADGKQARQKWGRMVQPDHHAAPGGGGGGGGGARRLKGLAKKAVGKGCFGLPLDRIGSMSGMGC

SEQ ID NO: 52 - protein, 256 aa, Bothrops jararaca
MVLSRLAASGLLLLALLALSVDGKPVQQWAQSWPGPNIPPLKVQQWAQGGWPRPGPEIPPLTVQQWAQNWPHPQIPPLTVQQWAQGRAPGPPIPPLTVQQWAQGRAPHPPIPPAPLQKWAPLQKWAPLLQPHESPASGTTALREELSLGPEAASGVPSAGAEVGRSGSKAPAAPHRLSKSKGAAATRPMRDLRPDGKQARQNWGRMAHHDHHAAAGGGGGGGGGARRLKGLAKKGAAKGCFGLKLDRIGTMSGLGC

SEQ ID NO: 53 - protein, 265 aa, Bothrops jararaca
MVLSRLAASGLLLLALLALSVDGKPVQQWAQGGWPRPGPEIPPLKVQQWAQGGWPRPGPEIPPLTVQQWAQNWPHPQIPPLTVQQWAQWGRPPGPPIPPLTVQQWAQARPPHPPIPPAPLQKWAPVQKWAPLLQPHESPASGTTALREELSLGPEAASGVPSAGAEVGRSGSKAPAAPHRLSKSKGAAATSAASRPMRDLRPDGKQARQNWGRMVHHDHHAAVGGGGGGGGGGARRLKGLAKKGAAKGCFGLKVDRIGTMSGLGC

SEQ ID NO: 54 - protein, 265 aa, Bothrops insularis
MVLSRLAASGLLLLALLALSVDGKPVQQWAQGGWPRPGPEIPPLKVQQWAQGGWPRPGPEIPPLTVQQWAQNWPHPQIPPLTVQQWAQLGPPPRPQIPPLEVQQWAQGRAPHPPIPPAPLQKWAPVQKWAPLLQPHESPASGTTALREELSLGPEAASGVPSAGAEVGRSGSKAPAAPHRLSKSKGAAATSAASRPMRDLRPDGKQARQNWGRMVHHDHHAAVGGGGGGGGGGARRLKGLAKKGAAKGCFGLKLDRIGTMSGLGC

SEQ ID NO: 55 - protein, 181 aa, Crotalus durissus terrificus
MFVSRLAASGLLLLALLAVSLDGKPLQQWSQRWPHLEIPPLVVQNWKSPTQLQARESPAGGTTALREELSLGPEAALDTPPAGPDGGPRGSKAAAAAPQRLSKSKGASATSAASRDLRTDGKQARQNWGRLVSPDHHSAAGGGCGGGGGARRLKGLAKKRAGNGCFGLKLDRIGSMSGLGC

SEQ ID NO: 56 - protein, 181 aa, Crotalus durissus collilineatus
MFVSRLAASGLLLLALLAVSLDGKPLQQWSQRWPHLEIPPLVVQNWKSPTQLQARESPAGGTTALREELSLGPEAALDTPPAGPDGGPRGSKAAAAAPQRLSKSKGASATSAASRDLRTDGKQARQNWGRLVSPDHHSAAGGGGGGGGGARRLKGLAKKRAGNGCFGLKLDRIGSMSGLGC

SEQ ID NO: 57 - protein, 201 aa, Sistrurus catenatus edwardsii
MFVSRLAASGLLLLALLAVSLDGKPVQQWSQNWPGPKVPPLVVQQWSQNWPHPQIPPLVVQNWKSPTQLQPRESPAGGTTALREELSLGPDAALDTPPAGPDVGPRGSKAAAAPQRLSKSKGASATSTASRPMRDLRTDGKQARQNWGRMLNPDHHSAPGGGGGGGGGGARRLKGLAKKRAGSGCFGLKLDRIGSMSGLGC

SEQ ID NO: 58 - protein, 239 aa, Lachesis muta muta
MFVSRLAASGLLLLALLAVSLDGKPVQQWSHKGWPPRPQIPPLVVQQWSQKPWPPGHHIPPVVVQEWPPGHHIPPLVVQQWSQKKWPPGHHIPPLVVQKWDPPPISPPLLKPHESPAGGTTALREELSLGPEAALDTPPAGPDVGPRGSKAPAAPHRLPKSKGASATSAASRPMRDLRTDGKQARQNWGRMMNPDHHAVGGGGGGGGARRLKGLAKKRVGDGCFGLKLDRIGSMSGLGC

SEQ ID NO: 59 - protein, 263 aa, Agkistrodon halys blomhoffi
MFVSRLAASGLLLLALMALSLDGKPVQQWSQGRPPGPPIPRLVVQQWSQGLPPGPPIPRLVVQQWSQGLPPGPPIPPLVVQQWSQGLPPRPKIPPLVVQQWSQGLPPRPKIPPLVVQKWDPPPVSPPLLLQPHESPAGGTTALREELSLGPEAASGPAAAGADGGRSGSKAPAALHRLSKSKGASATSASASRPMRDLRTDGKQARQNWARMVNPDHHAVGGCCCGGGGGGARRLKGLVKKGVAKGCFGLKLDRIGTMSGLGC

SEQ ID NO: 60 - protein, 164 aa, Philodryas olfersii
MVASRLAAGGLLLLALLALALDGKPAPPQPLRKAPAGGTTAWRRELTEQPEGASRPAAGGGGGGGRSGSKAANAAPTAPKSKGGAAAAAAAAARLMRDLRPDSKQARAAWGRMVHPEHHAGGGGGGGGGGGASRRLKGVAKKGLGKGCFGLKLDRIGSMSGLGC

SEQ ID NO: 61 - protein, 161 aa, Rhabdophis tigrinus tigrinus
MFASRLAALGLLLLALVLDGKPAPPPQPLRKAPAGGTTALQRQLTEQQQQQQQAEGSSGPAAGGGGGRSGSKTANAAPTAPKSKGAAASAASRLLRDLRPDGKQSRAAWGRMVHPEHHAGGGGGGGGGGSRRLKGLPKKGLGSGCFGLKLDRIGSMSGLGC

SEQ ID NO: 62 - protein, 221 aa, Bothrops jararacussu
HEKPSRSGAKSAAVGAKLAASSDSAADECSSGRKGEPPGPPIPPLTVQQWAQARPPHPPIPPAPLQKWAPVQKWAPVQKWAPLLQPHESPAGGTTALREELSLGPEAASGVPSAGAEGRAQRLEGARCTPSAVEEQRGGGDLGGVAADAGLAPRRQAGAAELGPDGAPRPPRPPRSGRRAAAAAAAERGARRLKGLAKKGAAKGCFGLKLDRIGTMSGLGC

SEQ ID NO: 63 - protein, 116 aa, Petromyzontidae
SGSEPWEGGFLPRVSSSSSSSSGEVEPLAEVTATGGVSGGVSGGVLGGTPWVGPRGHQRPSRGLAEGGSQVSGGVWQRLFNDFVSNQRRFRGRTKKGKGCFGVKLDRIGSMSGLGC

SEQ ID NO: 64 - protein, 148 aa, Lampetra japonica
MKLQLLMMVVVVGSWTFLGVGAKPLTSYELYDDAGSEPWEGGFLPRISSSSSSSAERLADATVTRHGGGGGGGGDDGTSWELPQGPPGPPRSSRGLAEGGSQVSGGVWQRLFNDFVSNQRRFRGRTKKGKGCFGVKLDRIGSMSGLGC

SEQ ID NO: 65 - protein, 133 aa, Petromyzontidae
MRRQVLVMVVMVVVMVVMSGKSVTAKPVASYELLDDTNSEPWEGGSLLPSLPSQGEGDSHPLSAEGGPWERGSGPQRSSRGIGGGSQVSGEVWQRLFNDFVSNQRRFRGRTKKGKGCFGVKLDRIGSMSGLGC

SEQ ID NO: 66 - protein, 22 aa, Gallus gallus
GLSRSCFGVKLDRIGSMSGLGC

SEQ ID NO: 67 - protein, 130 aa, Gallus gallus
MKLLFCPGFFLLLIVSQKQAMAKPISSLQSLSMLLDEELQHPLVSEERDREQDGSIPVGAFDQEDAEFQWTRNTRDQPASTSTADSDVQRILSDLLGLPQRYQNRSKKGLSRSCFGVKLDRIGSMSGLGC

SEQ ID NO: 68 - protein, 129 aa, Rana catesbeiana
MSYKRGTCLGFIMLLMVSHHHTKGKPLSSLQNLSRLLEDNFERSFGSDEADQQLVPTDSLDQLDPELQWNKNRLEQGDSPHVNEMTLQQLLNDPVGTSRRYRQRNKKGYSRGCFGVKLDRIGAFSGLGC

SEQ ID NO: 69 - protein, 136 aa, Triakis scyllium
MSGQTSFYCGLLLVLLIQAQARPRSDDSLQTLSRLLEDEYGHYLPSDELNNEAQEMSPAASLPEFNADQSDLELPWDRESREIGGRPFRQEAVLARLLKDLSNNPLRFRGRSKKGPSRGCFGVKLDRIGAMSGLGC

SEQ ID NO: 70 - protein, 115 aa, Scyliorhinus canicula
RPRSDDSLQTLSRLLEDEYGHYLPSDELNNEAEEMSPAASLPELNADQSDLELPWERESREIGGRPFRQEAVLARLLKDLSNNPLRFRGRSKKGPSRGCFGVKLDRIGAMSGLGC

SEQ ID NO: 71 - protein, 135 aa, Squalus acanthias
MSGHTSFYCGLLLLLLIQVQARPRADDSLQVLSRLLEDEYGHFNSEELNNEAQEISPAASLPDLNTDQSDLELPWDRESREIGGRSFRQEALLARLLQDLSNNPLRFKGRSKKGPSRSCFGLKLDRIGAMSGLGC

SEQ ID NO: 72 - protein, 131 aa, Chondrichthyes
MSGNTNFYCGLVLLLLLQVQGRPRSDDSLQALTRLLEDEYGQYFTTEDLNNEAPEIPPAASLPDLNTDQSDLDLSWDRESREIASRPILARILKDLSNNPLRFRGRSKKGPSRGCFGVKLDRIGAMSGLGC

SEQ ID NO: 73 - protein, 131 aa, Chondrichthyes; identical to SEQ ID NO: 72

SEQ ID NO: 74 - protein, 131 aa, Chondrichthyes
MSGNTNFYCGLVLLLLLQVQGRPRSDDSLQALTRLLEDEYGQYFTSEDLNNEAPEIPPAASLPDLNTDQPDFDLSWDRESREIASRPILARILKDLSNNPLRFRGRSKKGPSRGCFGVKLDRIGAMSGLGC

SEQ ID NO: 75 - protein, 131 aa, Dasyatis akajei
MSGNTNFYCGLVLLLLLQVQGRPRSDDSLQALTRLLEDEYGQYFTSEDLNNEAPEMSPAASLPDLNTEQSETDLPWDRESREIASRPILARILKDLNNIPLRFRGRSKKGPSRGCFGVKLDRIGAMSGLGC

SEQ ID NO: 76 - protein, 139 aa, Callorhynchus milii
MNAHVSFPCGLMLLLLIQVQVQARPRTGVDSLQILSRLLEDEYGPYLSSEDSDMEAEEASRAGTLRDLNLDQADMDLLWDRDARDIGGRSFQHDGLLLRLLKDLTISPLRFNGRSKKGPSRGCFGVKLDRIGAMSGLGC

SEQ ID NO: 77 - protein, 112 aa, Oryzias latipes
MSLRAFMLCVCLLLQSVGARPASELQNLERLLQDQLSSTEHPEEDRLDRTREEPQLGGSSSREAADESALTRLFADLLRTSKRSWGRYKKGGMRSCFGVRLERIGSFSGLGC

SEQ ID NO: 78 - protein, 112 aa, Oryzias latipes; identical to SEQ ID NO: 77

SEQ ID NO: 79 - protein, 158 aa, Takifugu rubripes
MSLNLPGYALFFILLVASSGAKPAPDLQILEPPLSSLEEQEEMQEEVQEKVQEQQEEVQEKVQEQQEEVQEQQEEVQEQQEEQQEEVQERGRGTGDVLLRAQLDSSTWALQKDDVLMRLFKDLLRTSKRSRSRYKKGGLRSCFGVRLARIGSFSGLGC

SEQ ID NO: 80 - protein, 128 aa, Salmo salar
MKMISNIQFFCLTALVLLNLVGANPMSNLQSLKQLLEEESHVPYYASDEMGVDGKDLNTENIAEEVPPWDSEDARNSALTGKEDVIARLLNDIMTTPKRSWSRFKKGGLRSCFGVRLERIGSFSGLGC

SEQ ID NO: 81 - protein, 126 aa, Esox lucius
MISNIQFCCLSVLVLLNLVGAKPVSNLQSLKEFLEESNVPYYGSEESEVDDKDLNTEKEAFTGEVVQPWLTEDRSALTGKENAVARLLSDIMTTPKRSWGRFKKGGMRSCFGVRLERIGSFSGLGC

SEQ ID NO: 82 - protein, 128 aa, Anguilla japonica
MISNITIYCISSLLFLNLVGGKPVSSLQSLKELLEEESNAPYLDSEEAEVQGKEMNAENAAFTKASLHSWDPNSRDAALSSNENALVRLLNDILSSSKRSWSRFKKGGLRSCFGVRLERIGSFSGLGC

SEQ ID NO: 83 - protein, 128 aa, Danio rerio
MIANISVFCVSSLLLLNLVGAKPVSSLQSLKQLLDEEVNKPFEESQESVMEQKDATAEKSALDERAEQLWESDARNSALAGKYGMFERLLGDLLSTSKRSWSRFKKGDLRSCFGVRLERIGSFSGLGC

SEQ ID NO: 84 - protein, 130 aa, Actinopterygii
MVSRLTVYCALFIIVLSQVSAKPVSSLQSFAQLLEDESNHPYVDSDDDTRGGLDVSAEIATDDSEADIPWNHNFRDLQHRQAAHSSRMLKLLKDILTSSGRSWDREKKSGLRSCFGVRLDRIGSMSGLGC

SEQ ID NO: 85 - protein, 131 aa, Oncorhynchus mykiss
MLYPALLCAALLLIAPLGHTEGRTLYPSPDAIQFVEQFLDRYNDLTLDDLENLVSSQPEEPSSAFTSGVKIAEYPKWADIPAQGDSTWLRLLKGTLANQKRAVTDRSRRGWNRGCFGLKLDRIGSMSGLGC

SEQ ID NO: 86 - protein, 131 aa, Oncorhynchus mykiss
MLYPALLCAALLLIAPLGHTEGRTLHPSPDAIQFVEQFLDRYNDLTLDDLENLVSSQPEEPSSAFTSGVKVAEYPKWADIPAQGDSTWLRLLKGTLANQKRAVMDRSRRGWNRGCFGLKLDRIGSMSGLGC

SEQ ID NO: 87 - protein, 132 aa, Osmerus mordax
MLCPVLLCATLVLLPPLELSEGRALHPSPEGLQFVEQFLERCTDLLNLDDLENAGSNQPEEPSDYANGVKVAEYPKWADLPAAQEDSAWLRLLKAALANQKRAEPDRSRRAWNRGCFGLKLDRIGSMSGLGC

SEQ ID NO: 88 - protein, 131 aa, Oreochromis mossambicus
MLCPVLLCAALLLLTPLEITEARALHPSPDAVQFVEQFLERYNDLLTLDDLENMLNSQAEEQSTLSSGSKAVEYPKWADAQTQPETPWLRLLKGALANQKRAEPDRSRRGWNRGCFGLKLDRIGSMSGLGC

SEQ ID NO: 89 - protein, 131 aa, Anoplopoma fimbria
MLCPVLLCATLLLLTPLEITEARALHPPPDAVQFMEQFLERYNDLLTLDDLENLLNSQPEEQSTFSSGVKAAEYPKWADAQTQAETPWLRLLKGAVANQKRAEPDRSRRGWNRGCFGLKLDRIGSMSGLGC

SEQ ID NO: 90 - protein, 131 aa, Oryzias latipes
MLCPVLLCATLLLLTPFEVTEARALHPSADAVQFVEQFLDRYNDLLTLDDLENLLNTQPEEQSTLSSGVKTAEYPKWADLQTQPETPWFRLLKGALTNQKRAEPDRSRRGWNRGCFGLKLDRIGSMSGLGC

SEQ ID NO: 91 - protein, 126 aa, Takifugu rubripes
MLCPALLCAALLLLTPVEITDARALQQPSDAAQFMEQFLESYNDLLTLDDLENMLNSHPEDQSNLSSSKADEYPKWAEADTPWLRLLRGALANQKRAEPDRSRRGWNRGCFGLKLDRIGSMSGLGC

SEQ ID NO: 92 - protein, 131 aa, Anguilla japonica
MMCKALVFAVLLLAVPLERADSRALRTPVDAIQFVEQFLEHYNDLLNIDDLENQTGDQLESPQPLSSGLKVAEYPKWVDVPSQNDNTWFRLLRGALANRKRALPDRAKRGWNRGCFGLKLDRIGSLSGLGC

SEQ ID NO: 93 - protein, 140 aa, Actinopterygii
MMGSCSAPLLTGHRILCLFLLMASSLSPIHSRAFRSPPLQFLSTLLEKEYGNLQSGPVNIHNVSSEQYEDPQPWADVSSVSKEQIWGDEPPANENALYLLLRRAAANRTWISADRVKKAWSKGCFGLKLDRIGSISGLGC

SEQ ID NO: 94 - protein, 123 aa, Gallus gallus
MLGLPAWPCSLFLLLVLLSASVQAMSSSGQRLQVLLSQLLPSDSESMPAEEDMKEGSSSEPQLLSPPLPLLPSRARAAHPLLWRKALASRKRALSGDWAWKAVPRGCFGLKMDRIGAFSGLGC

SEQ ID NO: 95 - protein, 17 aa, Artificial Sequence
  CONSENSUS SEQUENCE
  MISC_FEATURE (4)..(7): Xaa can be any naturally occurring amino acid or any amino acid at the corresponding position in one of SEQ ID NOs: 31-94
  MISC_FEATURE (10)..(12): Xaa can be any naturally occurring amino acid or any amino acid at the corresponding position in one of SEQ ID NOs: 31-94
  MISC_FEATURE (15)..(15): Xaa can be any naturally occurring amino acid or any amino acid at the corresponding position in one of SEQ ID NOs: 31-94
CFGXXXXRIXXXSGXGC

SEQ ID NO: 96 - protein, 28 aa, Rattus norvegicus
SLRRSSCFGGRIDRIGAQSGLGCNSFRY

SEQ ID NO: 97 - protein, 45 aa, Rattus norvegicus
SQDSAFRIQERLRNSKMAHSSSCFGQKIDRIGAVSRLGCDGLRLF

SEQ ID NO: 98 - protein, 32 aa, Sus scrofa
SPKTMRDSGCFGRRLDRIGSLSGLGCNVLRRY

SEQ ID NO: 99 - protein, 39 aa, Artificial Sequence
  Synthetic Construct (TNP-C)
SDSKIGNGCFGFPLDRIGSVSGLGCNRIMQNPPKKFSGE

SEQ ID NO: 100 - protein, 37 aa, Artificial Sequence
  Synthetic Construct (CDNP)
GLSKGCFGLKLDRIGSMSGLGCPSLRDPRPNAPSTSA

SEQ ID NO: 101 - protein, 37 aa, Artificial Sequence
  Synthetic Construct (CDNP-N1 (C7))
GLSKGCFGLKLDRIGSMSGLGCNSLRDPRPNAPSTSA

SEQ ID NO: 102 - protein, 37 aa, Artificial Sequence
  Synthetic Construct (CDNP-G1 (C8))
GLSKGCFGLKLDRIGSMSGLGCGSLRDPRPNAPSTSA

SEQ ID NO: 103 - protein, 37 aa, Artificial Sequence
  Synthetic Construct (CDNP-H1 (C9))
GLSKGCFGLKLDRIGSMSGLGCHSLRDPRPNAPSTSA

SEQ ID NO: 104 - protein, 37 aa, Artificial Sequence
  Synthetic Construct (CDNP-K1)
GLSKGCFGLKLDRIGSMSGLGCKSLRDPRPNAPSTSA

SEQ ID NO: 105 - protein, 37 aa, Artificial Sequence
  Synthetic Construct (CDNP-Z1)
  MISC_FEATURE (23)..(23): Xaa is hydroxyproline
GLSKGCFGLKLDRIGSMSGLGCXSLRDPRPNAPSTSA

SEQ ID NO: 106 - protein, 37 aa, Artificial Sequence
  Synthetic Construct (CDNP-S3)
GLSKGCFGLKLDRIGSMSGLGCPSSRDPRPNAPSTSA

SEQ ID NO: 107 - protein, 37 aa, Artificial Sequence
  Synthetic Construct (CDNP-A4)
GLSKGCFGLKLDRIGSMSGLGCPSLADPRPNAPSTSA

SEQ ID NO: 108 - protein, 37 aa, Artificial Sequence
  Synthetic Construct (CDNP-A5)
GLSKGCFGLKLDRIGSMSGLGCPSLRAPRPNAPSTSA

SEQ ID NO: 109 - protein, 37 aa, Artificial Sequence
  Synthetic Construct (CDNP-S3A4 (C12))
GLSKGCFGLKLDRIGSMSGLGCPSSADPRPNAPSTSA

SEQ ID NO: 110 - protein, 37 aa, Artificial Sequence
  Synthetic Construct (CDNP-A4A5)
GLSKGCFGLKLDRIGSMSGLGCPSLAAPRPNAPSTSA

SEQ ID NO: 111 - protein, 37 aa, Artificial Sequence
  Synthetic Construct (CDNP-S3A5 (C11))
GLSKGCFGLKLDRIGSMSGLGCPSSRAPRPNAPSTSA

SEQ ID NO: 112 - protein, 37 aa, Artificial Sequence
  Synthetic Construct (CDNP-(A17)S3A5)
GLSKGCFGLKLDRIGSASGLGCPSSRAPRPNAPSTSA

SEQ ID NO: 113 - protein, 37 aa, Artificial Sequence
  Synthetic Construct (CDNP-S3A4A5 (C10))
GLSKGCFGLKLDRIGSMSGLGCPSSAAPRPNAPSTSA

SEQ ID NO: 114 - protein, 37 aa, Artificial Sequence
  Synthetic Construct (CDNP-(A17)S3A4A5)
GLSKGCFGLKLDRIGSASGLGCPSSAAPRPNAPSTSA

SEQ ID NO: 115 - protein, 37 aa, Artificial Sequence
  Synthetic Construct (CDNP-S3A4A5R6 (C13))
GLSKGCFGLKLDRIGSMSGLGCPSSAARRPNAPSTSA

SEQ ID NO: 116 - protein, 37 aa, Artificial Sequence
  Synthetic Construct (CDNP-S3A4A5S7 (C14))
GLSKGCFGLKLDRIGSMSGLGCPSSAAPSPNAPSTSA

SEQ ID NO: 117 - protein, 15 aa, Artificial Sequence
  Synthetic Construct (DNP TAIL)
PSLRDPRPNAPSTSA

SEQ ID NO: 118 - protein, 15 aa, Artificial Sequence
  CONSENSUS SEQUENCE FOR DNP C-TERMINAL TAIL
  MISC_FEATURE (1)..(1): Xaa can be any naturally occurring amino acid or any amino acid at the corresponding position in one of SEQ ID NOs: 100-116
  MISC_FEATURE (3)..(7): Xaa can be any naturally occurring amino acid or any amino acid at the corresponding position in one of SEQ ID NOs: 100-116
XSXXXXXPNAPSTSA

SEQ ID NO: 119 - protein, 22 aa, Artificial Sequence
  Synthetic Construct (CNP-F17 (C15))
GLSKGCFGLKLDRIGSFSGLGC

SEQ ID NO: 120 - protein, 22 aa, Artificial Sequence
  Synthetic Construct (CNP-L17 (C16))
GLSKGCFGLKLDRIGSLSGLGC

SEQ ID NO: 121 - protein, 22 aa, Artificial Sequence
  Synthetic Construct (CNP-I17 (C17))
GLSKGCFGLKLDRIGSISGLGC

SEQ ID NO: 122 - protein, 22 aa, Artificial Sequence
  Synthetic Construct (CNP-T17 (C18))
GLSKGCFGLKLDRIGSTSGLGC

SEQ ID NO: 123 - protein, 22 aa, Artificial Sequence
  Synthetic Construct (CNP-V17 (C19))
GLSKGCFGLKLDRIGSVSGLGC

SEQ ID NO: 124 - protein, 22 aa, Artificial Sequence
  Synthetic Construct (CNP-A17 (C1))
GLSKGCFGLKLDRIGSASGLGC

SEQ ID NO: 125 - protein, 22 aa, Artificial Sequence
  Synthetic Construct (CNP-S17)
GLSKGCFGLKLDRIGSSSGLGC

SEQ ID NO: 126 - protein, 22 aa, Artificial Sequence
  CONSENSUS SEQUENCE
  MISC_FEATURE (17)..(17): Xaa can be any naturally occurring amino acid or any amino acid at the corresponding position in one of SEQ ID NOs: 119-125
GLSKGCFGLKLDRIGSXSGLGC

SEQ ID NO: 127 - protein, 37 aa, Artificial Sequence
  Synthetic Construct (CNP37)
QEHPNARKYKGANKKGLSKGCFGLKLDRIGSMSGLGC

SEQ ID NO: 128 - protein, 45 aa, Artificial Sequence
  Synthetic Construct (E6PGCNP37)
EEEEEEPGQEHPNARKYKGANKKGLSKGCFGLKLDRIGSMSGLGC

SEQ ID NO: 129 - protein, 43 aa, Artificial Sequence
  Synthetic Construct (C1(E6))
EEEEEESGGGGSGGGGSGGGGGLSKGCFGLKLDRIGSMSGLGC

SEQ ID NO: 130 - protein, 43 aa, Artificial Sequence
  Synthetic Construct (C2(E6))
EEEEEEASTSPANPQPAASSPGLSKGCFGLKLDRIGSMSGLGC

SEQ ID NO: 131 - protein, 43 aa, Artificial Sequence
  Synthetic Construct (C3(E6))
EEEEEEPSSAAPQPNAPSTSAGLSKGCFGLKLDRIGSMSGLGC

SEQ ID NO: 132 - protein, 43 aa, Artificial Sequence
  Synthetic Construct (C4(E6))
EEEEEESGGGGSGGGKGANKKGLSKGCFGLKLDRIGSMSGLGC

SEQ ID NO: 133 - protein, 43 aa, Artificial Sequence
  Synthetic Construct (C5(E6))
EEEEEESGGGGSGGGQGANQQGLSKGCFGLKLDRIGSMSGLGC

SEQ ID NO: 134 - protein, 43 aa, Artificial Sequence
  Synthetic Construct (C6(E6))
EEEEEESGGGGSGGGKGANKQGLSKGCFGLKLDRIGSMSGLGC

SEQ ID NO: 135 - protein, 43 aa, Artificial Sequence
  Synthetic Construct (C7(E6))
EEEEEESGGGGSGGGKGANQKGLSKGCFGLKLDRIGSMSGLGC

SEQ ID NO: 136 - protein, 43 aa, Artificial Sequence
  Synthetic Construct (C8(E6))
EEEEEESGGGGSGGGQGANKKGLSKGCFGLKLDRIGSMSGLGC

SEQ ID NO: 137 - protein, 43 aa, Artificial Sequence
  Synthetic Construct (C9(E6))
EEEEEESGGGGSGGGKGANQQGLSKGCFGLKLDRIGSMSGLGC

SEQ ID NO: 138 - protein, 43 aa, Artificial Sequence
  Synthetic Construct (C10(E6))
EEEEEESGGGGSGGGQGANQKGLSKGCFGLKLDRIGSMSGLGC

SEQ ID NO: 139 - protein, 43 aa, Artificial Sequence
  Synthetic Construct (C11(E6))
EEEEEESGGGGSGGGQGANKQGLSKGCFGLKLDRIGSMSGLGC

SEQ ID NO: 140 - protein, 43 aa, Artificial Sequence
  Synthetic Construct (D6CNP37)
DDDDDDQEHPNARKYKGANKKGLSKGCFGLKLDRIGSMSGLGC

SEQ ID NO: 141 - protein, 43 aa, Artificial Sequence
  Synthetic Construct (C1(D6))
DDDDDDSGGGGSGGGGSGGGGGLSKGCFGLKLDRIGSMSGLGC

SEQ ID NO: 142 - protein, 43 aa, Artificial Sequence
  Synthetic Construct (C2(D6))
DDDDDDASTSPANPQPAASSGGLSKGCFGLKLDRIGSMSGLGC

SEQ ID NO: 143 - protein, 43 aa, Artificial Sequence
  Synthetic Construct (C3(D6))
DDDDDDGSSAAPQPNAPSTSAGLSKGCFGLKLDRIGSMSGLGC

SEQ ID NO: 144 - protein, 43 aa, Artificial Sequence
  Synthetic Construct (C4(D6))
DDDDDDSGGGGSGGGKGANKKGLSKGCFGLKLDRIGSMSGLGC

SEQ ID NO: 145 - protein, 43 aa, Artificial Sequence
  Synthetic Construct (C5(D6))
DDDDDDSGGGGSGGGQGANQQGLSKGCFGLKLDRIGSMSGLGC

SEQ ID NO: 146 - protein, 43 aa, Artificial Sequence
  Synthetic Construct (C6(D6))
DDDDDDSGGGGSGGGKGANQKGLSKGCFGLKLDRIGSMSGLGC

SEQ ID NO: 147 - protein, 42 aa, Artificial Sequence
  Synthetic Construct (D6-14AAlinker-CNP)
DDDDDDGGGGSGGGGSGGGGGLSKGCFGLKLDRIGSMSGLGC

SEQ ID NO: 148 - protein, 42 aa, Artificial Sequence
  Synthetic Construct (CNP-14AAlinker-D6)
GLSKGCFGLKLDRIGSMSGLGCGGGGSGGGGSGGGGDDDDDD

SEQ ID NO: 149 - protein, 37 aa, Artificial Sequence
  Synthetic Construct (CNP-Nterm1)
GSSAAPRPNAPSTSAGLSKGCFGLKLDRIGSMSGLGC

SEQ ID NO: 150 - protein, 37 aa, Artificial Sequence
  Synthetic Construct (CNP-Nterm2)
ASTSPANPRPAASSGGLSKGCFGLKLDRIGSMSGLGC

SEQ ID NO: 151 - protein, 29 aa, Artificial Sequence
  Synthetic Construct (CDNP29-S3A4A5R6 [C14])
GLSKGCFGLKLDRIGSMSGLGCPSSAARR

SEQ ID NO: 152 - protein, 42 aa, Artificial Sequence
  Synthetic Construct (KA1)
HGPQGQEHPNARKYKGANKKGLSKGCFGLKLDRIGSMSGLGC

SEQ ID NO: 153 - protein, 48 aa, Artificial Sequence
  Synthetic Construct (KA1(E6))
EEEEEEHGPQGQEHPNARKYKGANKKGLSKGCFGLKLDRIGSMSGLGC

SEQ ID NO: 154 - protein, 42 aa, Artificial Sequence
  Synthetic Construct (KB1)
HKLRGQEHPNARKYKGANKKGLSKGCFGLKLDRIGSMSGLGC

SEQ ID NO: 155 - protein, 48 aa, Artificial Sequence
  Synthetic Construct (KB1(E6))
EEEEEEHKLRGQEHPNARKYKGANKKGLSKGCFGLKLDRIGSMSGLGC

SEQ ID NO: 156 - protein, 22 aa, Artificial Sequence
  Synthetic Construct (CNP-E17)
GLSKGCFGLKLDRIGSESGLGC

SEQ ID NO: 157 - protein, 22 aa, Artificial Sequence
  Synthetic Construct (CNP-R17)
GLSKGCFGLKLDRIGSRSGLGC

SEQ ID NO: 158 - protein, 22 aa, Artificial Sequence
  Synthetic Construct (CNP-Y17)
GLSKGCFGLKLDRIGSYSGLGC

SEQ ID NO: 159 - protein, 22 aa, Artificial Sequence
  Synthetic Construct (CNP-C17)
GLSKGCFGLKLDRIGSCSGLGC

SEQ ID NO: 160 - protein, 22 aa, Artificial Sequence
  Synthetic Construct (CNP-P17)
GLSKGCFGLKLDRIGSPSGLGC

SEQ ID NO: 161 - protein, 22 aa, Artificial Sequence
  Synthetic Construct (CNP-D17)
GLSKGCFGLKLDRIGSDSGLGC

SEQ ID NO: 162 - protein, 37 aa, Artificial Sequence
  Synthetic Construct (CNP37-X17)
  MISC_FEATURE (32)..(32): Xaa can be any naturally occurring amino acid, including but not limited to Phe, Leu, Ile, Thr, Glu, Arg, Tyr, Cys, Pro, or Asp
QEHPNARKYKGANKKGLSKGCFGLKLDRIGSXSGLGC

SEQ ID NO: 163 - protein, 37 aa, Artificial Sequence
  Synthetic Construct (CNP37-F17)
QEHPNARKYKGANKKGLSKGCFGLKLDRIGSFSGLGC

SEQ ID NO: 164 - protein, 37 aa, Artificial Sequence
  Synthetic Construct (CNP37-L17)
QEHPNARKYKGANKKGLSKGCFGLKLDRIGSLSGLGC

SEQ ID NO: 165 - protein, 37 aa, Artificial Sequence
  Synthetic Construct (CNP37-I17)
QEHPNARKYKGANKKGLSKGCFGLKLDRIGSISGLGC

SEQ ID NO: 166 - protein, 37 aa, Artificial Sequence
  Synthetic Construct (CNP37-T17)
QEHPNARKYKGANKKGLSKGCFGLKLDRIGSTSGLGC

SEQ ID NO: 167 - protein, 37 aa, Artificial Sequence
  Synthetic Construct (CNP37-E17)
QEHPNARKYKGANKKGLSKGCFGLKLDRIGSESGLGC

SEQ ID NO: 168 - protein, 37 aa, Artificial Sequence
  Synthetic Construct (CNP37-R17)
QEHPNARKYKGANKKGLSKGCFGLKLDRIGSRSGLGC

SEQ ID NO: 169 - protein, 37 aa, Artificial Sequence
  Synthetic Construct (CNP37-Y17)
QEHPNARKYKGANKKGLSKGCFGLKLDRIGSYSGLGC

SEQ ID NO: 170 - protein, 37 aa, Artificial Sequence
  Synthetic Construct (CNP37-C17)
QEHPNARKYKGANKKGLSKGCFGLKLDRIGSCSGLGC

SEQ ID NO: 171 - protein, 37 aa, Artificial Sequence
  Synthetic Construct (CNP37-P17)
QEHPNARKYKGANKKGLSKGCFGLKLDRIGSPSGLGC

SEQ ID NO: 172 - protein, 37 aa, Artificial Sequence
  Synthetic Construct (CNP37-D17)
QEHPNARKYKGANKKGLSKGCFGLKLDRIGSDSGLGC

SEQ ID NO: 173 - protein, 42 aa, Artificial Sequence
  Synthetic Construct (KA1-X17)
  MISC_FEATURE (37)..(37): Xaa can be any naturally occurring amino acid, including but not limited to Phe, Leu, Ile, Thr, Glu, Arg, Tyr, Cys, Pro, or Asp
HGPQGQEHPNARKYKGANKKGLSKGCFGLKLDRIGSXSGLGC

SEQ ID NO: 174 - protein, 42 aa, Artificial Sequence
  Synthetic Construct (KA2-X17)
  MISC_FEATURE (37)..(37): Xaa can be any naturally occurring amino acid, including but not limited to Phe, Leu, Ile, Thr, Glu, Arg, Tyr, Cys, Pro, or Asp
SGGGGQEHPNARKYKGANKKGLSKGCFGLKLDRIGSXSGLGC

SEQ ID NO: 175 - protein, 45 aa, Artificial Sequence
  Synthetic Construct (KA3-X17)
  MISC_FEATURE (40)..(40): Xaa can be any naturally occurring amino acid, including but not limited to Phe, Leu, Ile, Thr, Glu, Arg, Tyr, Cys, Pro, or Asp
GGGHGPQGQEHPNARKYKGANKKGLSKGCFGLKLDRIGSXSGLGC

SEQ ID NO: 176 - protein, 45 aa, Artificial Sequence
  Synthetic Construct (KA4-X17)
  MISC_FEATURE (40)..(40): Xaa can be any naturally occurring amino acid, including but not limited to Phe, Leu, Ile, Thr, Glu, Arg, Tyr, Cys, Pro, or Asp
GGGSGGGGQEHPNARKYKGANKKGLSKGCFGLKLDRIGSXSGLGC

SEQ ID NO: 177 - protein, 42 aa, Artificial Sequence
  Synthetic Construct (KA5-X17)
  MISC_FEATURE (37)..(37): Xaa can be any naturally occurring amino acid, including but not limited to Phe, Leu, Ile, Thr, Glu, Arg, Tyr, Cys, Pro, or Asp
SGGGGSGGGGSGGGKGANKKGLSKGCFGLKLDRIGSXSGLGC

SEQ ID NO: 178 - protein, 42 aa, Artificial Sequence
  Synthetic Construct (KA6-X17)
  MISC_FEATURE (37)..(37): Xaa can be any naturally occurring amino acid, including but not limited to Phe, Leu, Ile, Thr, Glu, Arg, Tyr, Cys, Pro, or Asp
HGPQGSGGGGSGGGKGANKKGLSKGCFGLKLDRIGSXSGLGC

SEQ ID NO: 179 - protein, 45 aa, Artificial Sequence
  Synthetic Construct (KA7-X17)
  MISC_FEATURE (40)..(40): Xaa can be any naturally occurring amino acid, including but not limited to Phe, Leu, Ile, Thr, Glu, Arg, Tyr, Cys, Pro, or Asp
GGGSGGGGSGGGGSGGGKGANKKGLSKGCFGLKLDRIGSXSGLGC

SEQ ID NO: 180 - protein, 45 aa, Artificial Sequence
  Synthetic Construct (KA8-X17)
  MISC_FEATURE (40)..(40): Xaa can be any naturally occurring amino acid, including but not limited to Phe, Leu, Ile, Thr, Glu, Arg, Tyr, Cys, Pro, or Asp
GGGHGPQGSGGGGSGGGKGANKKGLSKGCFGLKLDRIGSXSGLGC

SEQ ID NO: 181 - protein, 42 aa, Artificial Sequence
  Synthetic Construct (KB1-X17)
  MISC_FEATURE (37)..(37): Xaa can be any naturally occurring amino acid, including but not limited to Phe, Leu, Ile, Thr, Glu, Arg, Tyr, Cys, Pro, or Asp
HKLRGQEHPNARKYKGANKKGLSKGCFGLKLDRIGSXSGLGC

SEQ ID NO: 182 - protein, 45 aa, Artificial Sequence
  Synthetic Construct (KB2-X17)
  MISC_FEATURE (40)..(40): Xaa can be any naturally occurring amino acid, including but not limited to Phe, Leu, Ile, Thr, Glu, Arg, Tyr, Cys, Pro, or Asp
GGGHKLRGQEHPNARKYKGANKKGLSKGCFGLKLDRIGSXSGLGC

SEQ ID NO: 183 - protein, 42 aa, Artificial Sequence
  Synthetic Construct (KB3-X17)
  MISC_FEATURE (37)..(37): Xaa can be any naturally occurring amino acid, including but not limited to Phe, Leu, Ile, Thr, Glu, Arg, Tyr, Cys, Pro, or Asp
HKLRGSGGGGSGGGKGANKKGLSKGCFGLKLDRIGSXSGLGC

SEQ ID NO: 184 - protein, 45 aa, Artificial Sequence
  Synthetic Construct (KB4-X17)
  MISC_FEATURE (40)..(40): Xaa can be any naturally occurring amino acid, including but not limited to Phe, Leu, Ile, Thr, Glu, Arg, Tyr, Cys, Pro, or Asp
GGGHKLRGSGGGGSGGGKGANKKGLSKGCFGLKLDRIGSXSGLGC

SEQ ID NO: 185 - protein, 39 aa, Artificial Sequence
  Synthetic Construct (PGCNP37-X17)
  MISC_FEATURE (34)..(34): Xaa can be any naturally occurring amino acid, including but not limited to Phe, Leu, Ile, Thr, Glu, Arg, Tyr, Cys, Pro, or Asp
PGQEHPNARKYKGANKKGLSKGCFGLKLDRIGSXSGLGC

SEQ ID NO: 186 - protein, 48 aa, Artificial Sequence
  Synthetic Construct (KA1(E6)-X17)
  MISC_FEATURE (43)..(43): Xaa can be any naturally occurring amino acid, including but not limited to Phe, Leu, Ile, Thr, Glu, Arg, Tyr, Cys, Pro, or Asp
EEEEEEHGPQGQEHPNARKYKGANKKGLSKGCFGLKLDRIGSXSGLGC

SEQ ID NO: 187 - protein, 48 aa, Artificial Sequence
  Synthetic Construct (KA2(E6)-X17)
  MISC_FEATURE (43)..(43): Xaa can be any naturally occurring amino acid, including but not limited to Phe, Leu, Ile, Thr, Glu, Arg, Tyr, Cys, Pro, or Asp
EEEEEESGGGGQEHPNARKYKGANKKGLSKGCFGLKLDRIGSXSGLGC

SEQ ID NO: 188 - protein, 51 aa, Artificial Sequence
  Synthetic Construct (KA3(E6)-X17)
  MISC_FEATURE (46)..(46): Xaa can be any naturally occurring amino acid, including but not limited to Phe, Leu, Ile, Thr, Glu, Arg, Tyr, Cys, Pro, or Asp
EEEEEEGGGHGPQGQEHPNARKYKGANKKGLSKGCFGLKLDRIGSXSGLGC

SEQ ID NO: 189 - protein, 51 aa, Artificial Sequence
  Synthetic Construct (KA4(E6)-X17)
  MISC_FEATURE (46)..(46): Xaa can be any naturally occurring amino acid, including but not limited to Phe, Leu, Ile, Thr, Glu, Arg, Tyr, Cys, Pro, or Asp
EEEEEEGGGSGGGGQEHPNARKYKGANKKGLSKGCFGLKLDRIGSXSGLGC

SEQ ID NO: 190 - protein, 48 aa, Artificial Sequence
  Synthetic Construct (KA5(E6)-X17)
  MISC_FEATURE (43)..(43): Xaa can be any naturally occurring amino acid, including but not limited to Phe, Leu, Ile, Thr, Glu, Arg, Tyr, Cys, Pro, or Asp
EEEEEESGGGGSGGGGSGGGKGANKKGLSKGCFGLKLDRIGSXSGLGC

SEQ ID NO: 191 - protein, 48 aa, Artificial Sequence
  Synthetic Construct (KA6(E6)-X17)
  MISC_FEATURE (43)..(43): Xaa can be any naturally occurring amino acid, including but not limited to Phe, Leu, Ile, Thr, Glu, Arg, Tyr, Cys, Pro, or Asp
EEEEEEHGPQGSGGGGSGGGKGANKKGLSKGCFGLKLDRIGSXSGLGC

SEQ ID NO: 192 - protein, 51 aa, Artificial Sequence
  Synthetic Construct (KA7(E6)-X17)
  MISC_FEATURE (46)..(46): Xaa can be any naturally occurring amino acid, including but not limited to Phe, Leu, Ile, Thr, Glu, Arg, Tyr, Cys, Pro, or Asp
EEEEEEGGGSGGGGSGGGGSGGGKGANKKGLSKGCFGLKLDRIGSXSGLGC

SEQ ID NO: 193 - protein, 51 aa, Artificial Sequence
  Synthetic Construst (KA8(E6)-X17)
  MISC_FEATURE (46)..(46): Xaa can be any naturally occurring amino acid, including but not limited to Phe, Leu, Ile, Thr, Glu, Arg, Tyr, Cys, Pro, or Asp
EEEEEEGGGHGPQGSGGGGSGGGKGANKKGLSKGCFGLKLDRIGSXSGLGC

SEQ ID NO: 194 - protein, 48 aa, Artificial Sequence
  Synthetic Construct (KB1(E6)-X17)
  MISC_FEATURE (43)..(43): Xaa can be any naturally occurring amino acid, including but not limited to Phe, Leu, Ile, Thr, Glu, Arg, Tyr, Cys, Pro, or Asp
EEEEEEHKLRGQEHPNARKYKGANKKGLSKGCFGLKLDRIGSXSGLGC

SEQ ID NO: 195 - protein, 51 aa, Artificial Sequence
  Synthetic Construct (KB2(E6)-X17)
  MISC_FEATURE (46)..(46): XXaa can be any naturally occurring amino acid, including but not limited to Phe, Leu, Ile, Thr, Glu, Arg, Tyr, Cys, Pro, or Asp
EEEEEEGGGHKLRGQEHPNARKYKGANKKGLSKGCFGLKLDRIGSXSGLGC

SEQ ID NO: 196 - protein, 48 aa, Artificial Sequence
  Synthetic Construct (KB3(E6)-X17)
  MISC_FEATURE (43)..(43): Xaa can be any naturally occurring amino acid, including but not limited to Phe, Leu, Ile, Thr, Glu, Arg, Tyr, Cys, Pro, or Asp
EEEEEEHKLRGSGGGGSGGGKGANKKGLSKGCFGLKLDRIGSXSGLGC

SEQ ID NO: 197 - protein, 51 aa, Artificial Sequence
  Synthetic Construct (KB4(E6)-X17)
  MISC_FEATURE (46)..(46): Xaa can be any naturally occurring amino acid, including but not limited to Phe, Leu, Ile, Thr, Glu, Arg, Tyr, Cys, Pro, or Asp
EEEEEEGGGHKLRGSGGGGSGGGKGANKKGLSKGCFGLKLDRIGSXSGLGC

SEQ ID NO: 198 - protein, 45 aa, Artificial Sequence
  Synthetic Construct (E6PGCNP37-X17)
  MISC_FEATURE (40)..(40): Xaa can be any naturally occurring amino acid, including but not limited to Phe, Leu, Ile, Thr, Glu, Arg, Tyr, Cys, Pro, or Asp
EEEEEEPGQEHPNARKYKGANKKGLSKGCFGLKLDRIGSXSGLGC

SEQ ID NO: 199 - protein, 43 aa, Artificial Sequence
  Synthetic Construct (C1(E6)-X17)
  MISC_FEATURE (38)..(38): Xaa can be any naturally occurring amino acid, including but not limited to Phe, Leu, Ile, Thr, Glu, Arg, Tyr, Cys, Pro, or Asp
EEEEEESGGGGSGGGGSGGGGGLSKGCFGLKLDRIGSXSGLGC

SEQ ID NO: 200 - protein, 43 aa, Artificial Sequence
  Synthetic Construct (C2(E6)-X17)
  MISC_FEATURE (38)..(38): Xaa can be any naturally occurring amino acid, including but not limited to Phe, Leu, Ile, Thr, Glu, Arg, Tyr, Cys, Pro, or Asp
EEEEEEASTSPANPQPAASSPGLSKGCFGLKLDRIGSXSGLGC

SEQ ID NO: 201 - protein, 43 aa, Artificial Sequence
  Synthetic Construct (C3(E6)-X17)
  MISC_FEATURE (38)..(38): Xaa can be any naturally occurring amino acid, including but not limited to Phe, Leu, Ile, Thr, Glu, Arg, Tyr, Cys, Pro, or Asp
EEEEEEPSSAAPQPNAPSTSAGLSKGCFGLKLDRIGSXSGLGC

SEQ ID NO: 202 - protein, 43 aa, Artificial Sequence
  Synthetic Construct (C4(E6)-X17)
  MISC_FEATURE (38)..(38): Xaa can be any naturally occurring amino acid, including but not limited to Phe, Leu, Ile, Thr, Glu, Arg, Tyr, Cys, Pro, or Asp
EEEEEESGGGGSGGGKGANKKGLSKGCFGLKLDRIGSXSGLGC

SEQ ID NO: 203 - protein, 43 aa, Artificial Sequence
  Synthetic Construct (C5(E6)-X17)
  MISC_FEATURE (38)..(38): Xaa can be any naturally occurring amino acid, including but not limited to Phe, Leu, Ile, Thr, Glu, Arg, Tyr, Cys, Pro, or Asp
EEEEEESGGGGSGGGQGANQQGLSKGCFGLKLDRIGSXSGLGC

SEQ ID NO: 204 - protein, 43 aa, Artificial Sequence
  Synthetic Construct (C6(E6)-X17)
  MISC_FEATURE (38)..(38): Xaa can be any naturally occurring amino acid, including but not limited to Phe, Leu, Ile, Thr, Glu, Arg, Tyr, Cys, Pro, or Asp
EEEEEESGGGGSGGGKGANKQGLSKGCFGLKLDRIGSXSGLGC

SEQ ID NO: 205 - protein, 43 aa, Artificial Sequence
  Synthetic Construct (C7(E6)-X17)
  MISC_FEATURE (38)..(38): Xaa can be any naturally occurring amino acid, including but not limited to Phe, Leu, Ile, Thr, Glu, Arg, Tyr, Cys, Pro, or Asp
EEEEEESGGGGSGGGKGANQKGLSKGCFGLKLDRIGSXSGLGC

SEQ ID NO: 206 - protein, 43 aa, Artificial Sequence
  Synthetic Construct (C8(E6)-X17)
  MISC_FEATURE (38)..(38): Xaa can be any naturally occurring amino acid, including but not limited to Phe, Leu, Ile, Thr, Glu, Arg, Tyr, Cys, Pro, or Asp
EEEEEESGGGGSGGGQGANKKGLSKGCFGLKLDRIGSXSGLGC

SEQ ID NO: 207 - protein, 43 aa, Artificial Sequence
  Synthetic Construct (C9(E6)-X17)
  MISC_FEATURE (38)..(38): Xaa can be any naturally occurring amino acid, including but not limited to Phe, Leu, Ile, Thr, Glu, Arg, Tyr, Cys, Pro, or Asp
EEEEEESGGGGSGGGKGANQQGLSKGCFGLKLDRIGSXSGLGC

SEQ ID NO: 208 - protein, 43 aa, Artificial Sequence
  Synthetic Construct (C10(E6)-X17)
  MISC_FEATURE (38)..(38): Xaa can be any naturally occurring amino acid, including but not limited to Phe, Leu, Ile, Thr, Glu, Arg, Tyr, Cys, Pro, or Asp
EEEEEESGGGGSGGGQGANQKGLSKGCFGLKLDRIGSXSGLGC

SEQ ID NO: 209 - protein, 43 aa, Artificial Sequence
  Synthetic Construct (C11(E6)-X17)
  MISC_FEATURE (38)..(38): Xaa can be any naturally occurring amino acid, including but not limited to Phe, Leu, Ile, Thr, Glu, Arg, Tyr, Cys, Pro, or Asp
EEEEEESGGGGSGGGQGANKQGLSKGCFGLKLDRIGSXSGLGC

SEQ ID NO: 210 - protein, 43 aa, Artificial Sequence
  Synthetic Construct (D6CNP37-X17)
  MISC_FEATURE (38)..(38): Xaa can be any naturally occurring amino acid, including but not limited to Phe, Leu, Ile, Thr, Glu, Arg, Tyr, Cys, Pro, or Asp
DDDDDDQEHPNARKYKGANKKGLSKGCFGLKLDRIGSXSGLGC

SEQ ID NO: 211 - protein, 43 aa, Artificial Sequence
  Synthetic Construct (C1(D6)-X17)
  MISC_FEATURE (38)..(38): Xaa can be any naturally occurring amino acid, including but not limited to Phe, Leu, Ile, Thr, Glu, Arg, Tyr, Cys, Pro, or Asp
DDDDDDSGGGGSGGGGSGGGGGLSKGCFGLKLDRIGSXSGLGC

SEQ ID NO: 212 - protein, 43 aa, Artificial Sequence
  Synthetic Construct (C2(D6)-X17)
  MISC_FEATURE (38)..(38): Xaa can be any naturally occurring amino acid, including but not limited to Phe, Leu, Ile, Thr, Glu, Arg, Tyr, Cys, Pro, or Asp
DDDDDDASTSPANPQPAASSGGLSKGCFGLKLDRIGSXSGLGC

SEQ ID NO: 213 - protein, 43 aa, Artificial Sequence
  Synthetic Construct (C3(D6)-X17)
  MISC_FEATURE (38)..(38): Xaa can be any naturally occurring amino acid, including but not limited to Phe, Leu, Ile, Thr, Glu, Arg, Tyr, Cys, Pro, or Asp
DDDDDDGSSAAPQPNAPSTSAGLSKGCFGLKLDRIGSXSGLGC

SEQ ID NO: 214 - protein, 43 aa, Artificial Sequence
  Synthetic Construct (C4(D6)-X17)
  MISC_FEATURE (38)..(38): Xaa can be any naturally occurring amino acid, including but not limited to Phe, Leu, Ile, Thr, Glu, Arg, Tyr, Cys, Pro, or Asp
DDDDDDSGGGGSGGGKGANKKGLSKGCFGLKLDRIGSXSGLGC

SEQ ID NO: 215 - protein, 43 aa, Artificial Sequence
  Synthetic Construct (C5(D6)-X17)
  MISC_FEATURE (38)..(38): Xaa can be any naturally occurring amino acid, including but not limited to Phe, Leu, Ile, Thr, Glu, Arg, Tyr, Cys, Pro, or Asp
DDDDDDSGGGGSGGGQGANQQGLSKGCFGLKLDRIGSXSGLGC

SEQ ID NO: 216 - protein, 43 aa, Artificial Sequence
  Synthetic Construct (C6(D6)-X17)
  MISC_FEATURE (38)..(38): Xaa can be any naturally occurring amino acid, including but not limited to Phe, Leu, Ile, Thr, Glu, Arg, Tyr, Cys, Pro, or Asp
DDDDDDSGGGGSGGGKGANQKGLSKGCFGLKLDRIGSXSGLGC

SEQ ID NO: 217 - protein, 42 aa, Artificial Sequence
  Synthetic Construct (D6-14AAlinker-CNP-X17)
  MISC_FEATURE (37)..(37): Xaa can be any naturally occurring amino acid, including but not limited to Phe, Leu, Ile, Thr, Glu, Arg, Tyr, Cys, Pro, or Asp
DDDDDDGGGGSGGGGSGGGGGLSKGCFGLKLDRIGSXSGLGC

SEQ ID NO: 218 - protein, 42 aa, Artificial Sequence
  Synthetic Construct (CNP-14AAlinker-D6-X17)
  MISC_FEATURE (17)..(17): Xaa can be any naturally occurring amino acid, including but not limited to Phe, Leu, Ile, Thr, Glu, Arg, Tyr, Cys, Pro, or Asp
GLSKGCFGLKLDRIGSXSGLGCGGGGSGGGGSGGGGDDDDDD

SEQ ID NO: 219 - protein, 37 aa, Artificial Sequence
  Synthetic Construct (CNP-Nterm1-X17)
  MISC_FEATURE (32)..(32): Xaa can be any naturally occurring amino acid, including but not limited to Phe, Leu, Ile, Thr, Glu, Arg, Tyr, Cys, Pro, or Asp
GSSAAPRPNAPSTSAGLSKGCFGLKLDRIGSXSGLGC

SEQ ID NO: 220 - protein, 37 aa, Artificial Sequence
  Synthetic Construct CNP-Nterm2-X17
  MISC_FEATURE (32)..(32): Xaa can be any naturally occurring amino acid, including but not limited to Phe, Leu, Ile, Thr, Glu, Arg, Tyr, Cys, Pro, or Asp
ASTSPANPRPAASSGGLSKGCFGLKLDRIGSXSGLGC

SEQ ID NO: 221 - protein, 48 aa, Artificial Sequence
  Synthetic Construct (KA1(E6)-L17)
EEEEEEHGPQGQEHPNARKYKGANKKGLSKGCFGLKLDRIGSLSGLGC

SEQ ID NO: 222 - protein, 48 aa, Artificial Sequence
  Synthetic Construct (KA2(E6)-L17)
EEEEEESGGGGQEHPNARKYKGANKKGLSKGCFGLKLDRIGSLSGLGC

SEQ ID NO: 223 - protein, 51 aa, Artificial Sequence
  Synthetic Construct (KA3(E6)-L17)
EEEEEEGGGHGPQGQEHPNARKYKGANKKGLSKGCFGLKLDRIGSLSGLGC

SEQ ID NO: 224 - protein, 51 aa, Artificial Sequence
  Synthetic Construct (KA4(E6)-L17)
EEEEEEGGGSGGGGQEHPNARKYKGANKKGLSKGCFGLKLDRIGSLSGLGC

SEQ ID NO: 225 - protein, 48 aa, Artificial Sequence
  Synthetic Construct (KA5(E6)-L17)
EEEEEESGGGGSGGGGSGGGKGANKKGLSKGCFGLKLDRIGSLSGLGC

SEQ ID NO: 226 - protein, 48 aa, Artificial Sequence
  Synthetic Construct (KA6(E6)-L17)
EEEEEEHGPQGSGGGGSGGGKGANKKGLSKGCFGLKLDRIGSLSGLGC

SEQ ID NO: 227 - protein, 51 aa, Artificial Sequence
  Synthetic Construct (KA7(E6)-L17)
EEEEEEGGGSGGGGSGGGGSGGGKGANKKGLSKGCFGLKLDRIGSLSGLGC

SEQ ID NO: 228 - protein, 51 aa, Artificial Sequence
  Synthetic Construct (KA8(E6)-L17)
EEEEEEGGGHGPQGSGGGGSGGGKGANKKGLSKGCFGLKLDRIGSLSGLGC

SEQ ID NO: 229 - protein, 48 aa, Artificial Sequence
  Synthetic Construct (KB1(E6)-L17)
EEEEEEHKLRGQEHPNARKYKGANKKGLSKGCFGLKLDRIGSLSGLGC

SEQ ID NO: 230 - protein, 51 aa, Artificial Sequence
  Synthetic Construct (KB2(E6)-L17)
EEEEEEGGGHKLRGQEHPNARKYKGANKKGLSKGCFGLKLDRIGSLSGLGC

SEQ ID NO: 231 - protein, 48 aa, Artificial Sequence
  Synthetic Construct (KB3(E6)-L17)
EEEEEEHKLRGSGGGGSGGGKGANKKGLSKGCFGLKLDRIGSLSGLGC

SEQ ID NO: 232 - protein, 51 aa, Artificial Sequence
  Synthetic Construct (KB4(E6)-L17)
EEEEEEGGGHKLRGSGGGGSGGGKGANKKGLSKGCFGLKLDRIGSLSGLGC

SEQ ID NO: 233 - protein, 45 aa, Artificial Sequence
  Synthetic Construct (E6PGCNP37-L17)
EEEEEEPGQEHPNARKYKGANKKGLSKGCFGLKLDRIGSLSGLGC

SEQ ID NO: 234-300 - skipped (67 entries)

SEQ ID NO: 301 - protein, 1 aa, Artificial Sequence
  Synthetic Construct
G

SEQ ID NO: 302 - protein, 2 aa, Artificial Sequence
  Synthetic Construct
GG

SEQ ID NO: 303 - protein, 3 aa, Artificial Sequence
  Synthetic Construct
GGG

SEQ ID NO: 304 - protein, 4 aa, Artificial Sequence
  Synthetic Construct
GGGG

SEQ ID NO: 305 - protein, 5 aa, Artificial Sequence
  Synthetic Construct
GGGGS

SEQ ID NO: 306 - protein, 6 aa, Artificial Sequence
  Synthetic Construct
GGGGSG

SEQ ID NO: 307 - protein, 14 aa, Artificial Sequence
  Synthetic Construct
GGGGSGGGGSGGGG

SEQ ID NO: 308 - protein, 16 aa, Artificial Sequence
  Synthetic Construct
GGGGSGGGGSGGGGSG

SEQ ID NO: 309 - protein, 22 aa, Artificial Sequence
  Synthetic Construct
GGGGSGGGGSGGGGSGGGGSGG

SEQ ID NO: 310 - protein, 28 aa, Artificial Sequence
  Synthetic Construct
GGGGSGGGGSGGGGSGGGGSGGGGSGGG

SEQ ID NO: 311 - protein, 34 aa, Artificial Sequence
  Synthetic Construct
GGGGSGGGGSGGGGSGGGGSGGGGSGGGGSGGGG

SEQ ID NO: 312 - protein, 40 aa, Artificial Sequence
  Synthetic Construct
GGGGSGGGGSGGGGSGGGGSGGGGSGGGGSGGGGSGGGGS

SEQ ID NO: 313 - protein, 46 aa, Artificial Sequence
  Synthetic Construct
GGGGSGGGGSGGGGSGGGGSGGGGSGGGGSGGGGSGGGGSGGGGSG

SEQ ID NO: 314 - protein, 6 aa, Artificial Sequence
  Synthetic Construct
KGANKK

SEQ ID NO: 315 - protein, 6 aa, Artificial Sequence
  Synthetic Construct
KGANQK

SEQ ID NO: 316 - protein, 6 aa, Artificial Sequence
  Synthetic Construct
KGANKQ

SEQ ID NO: 317 - protein, 6 aa, Artificial Sequence
  Synthetic Construct
KGANQQ

SEQ ID NO: 318 - protein, 6 aa, Artificial Sequence
  Synthetic Construct
QGANKK

SEQ ID NO: 319 - protein, 6 aa, Artificial Sequence
  Synthetic Construct
QGANQK

SEQ ID NO: 320 - protein, 6 aa, Artificial Sequence
  Synthetic Construct
QGANKQ

SEQ ID NO: 321 - protein, 6 aa, Artificial Sequence
  Synthetic Construct
QGANQQ

SEQ ID NO: 322 - protein, 16 aa, Artificial Sequence
  Synthetic Construct
GGGGSGGGGSKGANKK

SEQ ID NO: 323 - protein, 16 aa, Artificial Sequence
  Synthetic Construct
GGGGSGGGGSKGANQK

SEQ ID NO: 324 - protein, 16 aa, Artificial Sequence
  Synthetic Construct
GGGGSGGGGSKGANKQ

SEQ ID NO: 325 - protein, 16 aa, Artificial Sequence
  Synthetic Construct
GGGGSGGGGSKGANQQ

SEQ ID NO: 326 - protein, 16 aa, Artificial Sequence
  Synthetic Construct
GGGGSGGGGSQGANKK

SEQ ID NO: 327 - protein, 16 aa, Artificial Sequence
  Synthetic Construct
GGGGSGGGGSQGANQK

SEQ ID NO: 328 - protein, 16 aa, Artificial Sequence
  Synthetic Construct
GGGGSGGGGSQGANKQ

SEQ ID NO: 329 - protein, 16 aa, Artificial Sequence
  Synthetic Construct
GGGGSGGGGSQGANQQ

SEQ ID NO: 330 - protein, 34 aa, Artificial Sequence
  Synthetic Construct
GGGDLQVDTQSQAAWAQLLQEHPNAQQYKGANKK

SEQ ID NO: 331 - protein, 34 aa, Artificial Sequence
  Synthetic Construct
GGGGSGGGGSGGGGSGGGGSGGGGSGGGKGANKK

SEQ ID NO: 332 - protein, 34 aa, Artificial Sequence
  Synthetic Construct
GGGGSGGGGSGGGGSGGGGSGGGGSGGGKGANQK

SEQ ID NO: 333 - protein, 34 aa, Artificial Sequence
  Synthetic Construct
GGGGSGGGGSGGGGSGGGGSGGGGSGGGQGANQQ

SEQ ID NO: 334 - protein, 15 aa, Artificial Sequence
  Synthetic Construct
QEHPNARKYKGANKK

SEQ ID NO: 335 - protein, 16 aa, Artificial Sequence
  Synthetic Construct
GQEHPNARKYKGANKK

SEQ ID NO: 336 - protein, 17 aa, Artificial Sequence
  Synthetic Construct
PGQEHPNARKYKGANKK

SEQ ID NO: 337 - protein, 15 aa, Artificial Sequence
  Synthetic Construct
SGGGGSGGGGSGGGG

SEQ ID NO: 338 - protein, 15 aa, Artificial Sequence
  Synthetic Construct
ASTSPANPQPAASSP

SEQ ID NO: 339 - protein, 15 aa, Artificial Sequence
  Synthetic Construct
PSSAAPQPNAPSTSA

SEQ ID NO: 340 - protein, 15 aa, Artificial Sequence
  Synthetic Construct
SGGGGSGGGKGANKK

SEQ ID NO: 341 - protein, 15 aa, Artificial Sequence
  Synthetic Construct
SGGGGSGGGQGANQQ

SEQ ID NO: 342 - protein, 15 aa, Artificial Sequence
  Synthetic Construct
SGGGGSGGGKGANKQ

SEQ ID NO: 343 - protein, 15 aa, Artificial Sequence
  Synthetic Construct
SGGGGSGGGKGANQK

SEQ ID NO: 344 - protein, 15 aa, Artificial Sequence
  Synthetic Construct
SGGGGSGGGQGANKK

SEQ ID NO: 345 - protein, 15 aa, Artificial Sequence
  Synthetic Construct
SGGGGSGGGKGANQQ

SEQ ID NO: 346 - protein, 15 aa, Artificial Sequence
  Synthetic Construct
SGGGGSGGGQGANQK

SEQ ID NO: 347 - protein, 15 aa, Artificial Sequence
  Synthetic Construct
SGGGGSGGGQGANKQ

SEQ ID NO: 348 - protein, 15 aa, Artificial Sequence
  Synthetic Construct
ASTSPANPQPAASSG

SEQ ID NO: 349 - protein, 15 aa, Artificial Sequence
  Synthetic Construct
GSSAAPQPNAPSTSA

SEQ ID NO: 350 - protein, 20 aa, Artificial Sequence
  Synthetic Construct
GSSAAPRPNAPSTSAGLSKG

SEQ ID NO: 351 - protein, 15 aa, Artificial Sequence
  Synthetic Construct
ASTSPANPRPAASSG

SEQ ID NO: 352 - protein, 20 aa, Artificial Sequence
  Synthetic Construct
HGPQGQEHPNARKYKGANKK

SEQ ID NO: 353 - protein, 20 aa, Artificial Sequence
  Synthetic Construct
HKLRGQEHPNARKYKGANKK

SEQ ID NO: 354 - protein, 21 aa, Artificial Sequence
  Synthetic Construct
GHGPQGQEHPNARKYKGANKK

SEQ ID NO: 355 - protein, 21 aa, Artificial Sequence
  Synthetic Construct
GHKLRGQEHPNARKYKGANKK

SEQ ID NO: 356 - protein, 22 aa, Artificial Sequence
  Synthetic Construct
GGHGPQGQEHPNARKYKGANKK

SEQ ID NO: 357 - protein, 22 aa, Artificial Sequence
  Synthetic Construct
GGHKLRGQEHPNARKYKGANKK

SEQ ID NO: 358 - protein, 23 aa, Artificial Sequence
  Synthetic Construct
GGGHGPQGQEHPNARKYKGANKK

SEQ ID NO: 359 - protein, 23 aa, Artificial Sequence
  Synthetic Construct
GGGHKLRGQEHPNARKYKGANKK

SEQ ID NO: 360 - protein, 24 aa, Artificial Sequence
  Synthetic Construct
GGGGHGPQGQEHPNARKYKGANKK

SEQ ID NO: 361 - protein, 24 aa, Artificial Sequence
  Synthetic Construct
GGGGHKLRGQEHPNARKYKGANKK

SEQ ID NO: 362 - protein, 25 aa, Artificial Sequence
  Synthetic Construct
GGGGGHGPQGQEHPNARKYKGANKK

SEQ ID NO: 363 - protein, 25 aa, Artificial Sequence
  Synthetic Construct
GGGGGHKLRGQEHPNARKYKGANKK

SEQ ID NO: 364 - protein, 20 aa, Artificial Sequence
  Synthetic Construct
HGPQGSGGGGSGGGKGANKK

SEQ ID NO: 365 - protein, 20 aa, Artificial Sequence
  Synthetic Construct
HKLRGSGGGGSGGGKGANKK

SEQ ID NO: 366 - protein, 23 aa, Artificial Sequence
  Synthetic Construct
GGGHGPQGSGGGGSGGGKGANKK

SEQ ID NO: 367 - protein, 23 aa, Artificial Sequence
  Synthetic Construct
GGGHKLRGSGGGGSGGGKGANKK

SEQ ID NO: 368 - protein, 20 aa, Artificial Sequence
  Synthetic Construct
SGGGGQEHPNARKYKGANKK

SEQ ID NO: 369 - protein, 23 aa, Artificial Sequence
  Synthetic Construct
GGGSGGGGQEHPNARKYKGANKK

SEQ ID NO: 370 - protein, 20 aa, Artificial Sequence
  Synthetic Construct
SGGGGSGGGGSGGGKGANKK

SEQ ID NO: 371 - protein, 25 aa, Artificial Sequence
  Synthetic Construct
SGGGGSGGGGSGGGGSGGGKGANKK

SEQ ID NO: 372 - protein, 23 aa, Artificial Sequence
  Synthetic Construct
GGGSGGGGSGGGGSGGGKGANKK

SEQ ID NO: 373 - protein, 28 aa, Artificial Sequence
  Synthetic Construct
GGGSGGGGSGGGGSGGGGSGGGKGANKK

SEQ ID NO: 374 - protein, 5 aa, Artificial Sequence
  Synthetic Construct
HGPQG

SEQ ID NO: 375 - protein, 5 aa, Artificial Sequence
  Synthetic Construct
HKLRG

SEQ ID NO: 376 - protein, 6 aa, Artificial Sequence
  Synthetic Construct
GHGPQG

SEQ ID NO: 377 - protein, 7 aa, Artificial Sequence
  Synthetic Construct
GGHGPQG

SEQ ID NO: 378 - protein, 8 aa, Artificial Sequence
  Synthetic Construct
GGGHGPQG

SEQ ID NO: 379 - protein, 9 aa, Artificial Sequence
  Synthetic Construct
GGGGHGPQG

SEQ ID NO: 380 - protein, 10 aa, Artificial Sequence
  Synthetic Construct
GGGGGHGPQG

SEQ ID NO: 381 - protein, 6 aa, Artificial Sequence
  Synthetic Construct
GHKLRG

SEQ ID NO: 382 - protein, 7 aa, Artificial Sequence
  Synthetic Construct
GGHKLRG

SEQ ID NO: 383 - protein, 8 aa, Artificial Sequence
  Synthetic Construct
GGGHKLRG

SEQ ID NO: 384 - protein, 9 aa, Artificial Sequence
  Synthetic Construct
GGGGHKLRG

SEQ ID NO: 385 - protein, 10 aa, Artificial Sequence
  Synthetic Construct
GGGGGHKLRG

SEQ ID NO: 386 - protein, 17 aa, Artificial Sequence
  Synthetic Construct
GGQEHPNARKYKGANKK

SEQ ID NO: 387 - protein, 18 aa, Artificial Sequence
  Synthetic Construct
GGGQEHPNARKYKGANKK

SEQ ID NO: 388 - protein, 19 aa, Artificial Sequence
  Synthetic Construct
GGGGQEHPNARKYKGANKK

SEQ ID NO: 389 - protein, 20 aa, Artificial Sequence
  Synthetic Construct
GGGGGQEHPNARKYKGANKK

SEQ ID NO: 390-400 - skipped (11 entries)

SEQ ID NO: 401 - protein, 227 aa, Artificial Sequence
  Synthetic Construct (Exemplary Fc Sequence (IgG-1))
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 402-500 - skipped (99 entries)

SEQ ID NO: 501 - protein, 314 aa, Artificial Sequence
  Synthetic Construct (NC2st Protein Sequence (With Signal Sequence))
MGVHECPAWLWLLLSLLSLWPGAYAASWSHPQFEQSGGGGGENLYFQGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGLSKGCFGLKLDRIGSMSGLGC

SEQ ID NO: 502 - protein, 289 aa, Artificial Sequence
  Synthetic Construct (NC2st Protein Sequence (Without Signal Sequence))
ASWSHPQFEQSGGGGGENLYFQGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGLSKGCFGLKLDRIGSMSGLGC

SEQ ID NO: 503 - protein, 290 aa, Artificial Sequence
  Synthetic Construct (NC2B (w/ sig. seq.))
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGLSKGCFGLKLDRIGSMSGLGC

SEQ ID NO: 504 - protein, 265 aa, Artificial Sequence
  Synthetic Construct  (NC2B (w/o sig. seq.))
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGLSKGCFGLKLDRIGSMSGLGC

SEQ ID NO: 505 - protein, 296 aa, Artificial Sequence
  Synthetic Construct  (NC2B-22  (w/ sig. seq.))
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGLSKGCFGLKLDRIGSMSGLGC

SEQ ID NO: 506 - protein, 271 aa, Artificial Sequence
  Synthetic Construct (NC2B-22 (w/o sig. seq.))
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGLSKGCFGLKLDRIGSMSGLGC

SEQ ID NO: 507 - protein, 302 aa, Artificial Sequence
  Synthetic Construct (NC2B-28  (w/ sig. seq.))
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGLSKGCFGLKLDRIGSMSGLGC

SEQ ID NO: 508 - protein, 277 aa, Artificial Sequence
  Synthetic Construct (NC2B-28 (w/o sig. seq.))
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGLSKGCFGLKLDRIGSMSGLGC

SEQ ID NO: 509 - protein, 308 aa, Artificial Sequence
  Synthetic Construct (NC2B-34  (w/ sig. seq.))
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSGGGGGLSKGCFGLKLDRIGSMSGLGC

SEQ ID NO: 510 - protein, 283 aa, Artificial Sequence
  Synthetic Construct (NC2B-34 (w/o sig. seq.))
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSGGGGGLSKGCFGLKLDRIGSMSGLGC

SEQ ID NO: 511 - protein, 290 aa, Artificial Sequence
  Synthetic Construct (NC2-KGANKK (w/ sig. seq.))
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANKKGLSKGCFGLKLDRIGSMSGLGC

SEQ ID NO: 512 - protein, 265 aa, Artificial Sequence
  Synthetic Construct (NC2-KGANKK (w/o sig. seq.))
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANKKGLSKGCFGLKLDRIGSMSGLGC

SEQ ID NO: 513 - protein, 290 aa, Artificial Sequence
  Synthetic Construct (NC2-KGANQK (w/ sig. seq.))
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANQKGLSKGCFGLKLDRIGSMSGLGC

SEQ ID NO: 514 - protein, 265 aa, Artificial Sequence
  Synthetic Construct (NC2-KGANQK (w/o sig. seq.))
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANQKGLSKGCFGLKLDRIGSMSGLGC

SEQ ID NO: 515 - protein, 308 aa, Artificial Sequence
  Synthetic Construct (NC2-CNP53mut2 (w/ sig. seq.))
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLQVDTQSQAAWAQLLQEHPNAQQYKGANKKGLSKGCFGLKLDRIGSMSGLGC

SEQ ID NO: 516 - protein, 283 aa, Artificial Sequence
  Synthetic Construct (NC2-CNP53mut2 (w/o sig. seq.))
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLQVDTQSQAAWAQLLQEHPNAQQYKGANKKGLSKGCFGLKLDRIGSMSGLGC

SEQ ID NO: 517 - protein, 308 aa, Artificial Sequence [sequence omitted]

SEQ ID NO: 518 - protein, 283 aa, Artificial Sequence
  Synthetic Construct (Fc-CNP53-A (w/o sig. seq.))
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLRVDTKSRAAWARLLQEHPNARKYKGANKKGLSKGCFGLKLDRIGSASGLGC

SEQ ID NO: 519 - protein, 308 aa, Artificial Sequence
  Synthetic Construct (Fc-CNP53-AAA (w/ sig. seq.)
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLRVDTKSRAAWARLLQEHPNARKYKGANAAGLSKGCFGLKLDRIGSASGLGC

SEQ ID NO: 520 - protein, 283 aa, Artificial Sequence
  Synthetic Construct (Fc-CNP53-AAA (w/o sig. seq.))
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLRVDTKSRAAWARLLQEHPNARKYKGANAAGLSKGCFGLKLDRIGSASGLGC

SEQ ID NO: 521 - protein, 285 aa, Artificial Sequence
  Synthetic Construct (CNP-16AAlinker-Fc-His10 (NC1))
GLSKGCFGLKLDRIGSMSGLGCGGGGSGGGGSGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGENLYFQGSHHHHHHHHHH

SEQ ID NO: 522 - protein, 275 aa, Artificial Sequence
  Synthetic Construct (CNP-6AAlinker-Fc-His10 (NC3))
GLSKGCFGLKLDRIGSMSGLGCGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGENLYFQGSHHHHHHHHHH

SEQ ID NO: 523 - protein, 255 aa, Artificial Sequence
  Synthetic Construct (CNP-6AAlinker-Fc)
GLSKGCFGLKLDRIGSMSGLGCGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 524 - protein, 264 aa, Artificial Sequence
  Synthetic Construct (CDNP-Fc)
GLSKGCFGLKLDRIGSMSGLGCPSLRDPRPNAPSTSADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 525 - protein, 264 aa, Artificial Sequence
  Synthetic Construct (CDNP-A17saa-Fc)
GLSKGCFGLKLDRIGSASGLGCPSSAAPRPNAPSTSADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 526 - protein, 264 aa, Artificial Sequence
  Synthetic Construct (CDNP-A17sra-Fc)
GLSKGCFGLKLDRIGSASGLGCPSSRAPRPNAPSTSADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 527 - protein, 314 aa, Artificial Sequence
  Synthetic Construct (NC2st-X17 (w/ sig. seq.)
  MISC_FEATURE (309)..(309): Xaa can be any naturally occurring amino acid, including but not limited to Phe, Leu, Ile, Thr, Glu, Arg, Tyr, Cys, Pro, or Asp
MGVHECPAWLWLLLSLLSLWPGAYAASWSHPQFEQSGGGGGENLYFQGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGLSKGCFGLKLDRIGSXSGLGC

SEQ ID NO: 528 - protein, 289 aa, Artificial Sequence
  Synthetic Construct (NC2st-X17  (w/o sig. seq.))
  MISC_FEATURE (284)..(284): Xaa can be any naturally occurring amino acid, including but not limited to Phe, Leu, Ile, Thr, Glu, Arg, Tyr, Cys, Pro, or Asp
ASWSHPQFEQSGGGGGENLYFQGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGLSKGCFGLKLDRIGSXSGLGC

SEQ ID NO: 529 - protein, 290 aa, Artificial Sequence
  Synthetic Construct (NC2B-X17 w/ sig. seq.))
  MISC_FEATURE (285)..(285): Xaa can be any naturally occurring amino acid, including but not limited to Phe, Leu, Ile, Thr, Glu, Arg, Tyr, Cys, Pro, or Asp
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGLSKGCFGLKLDRIGSXSGLGC

SEQ ID NO: 530 - protein, 265 aa, Artificial Sequence
  Synthetic Construct (NC2B-X17 (w/o sig. seq.))
  MISC_FEATURE (260)..(260): Xaa can be any naturally occurring amino acid, including but not limited to Phe, Leu, Ile, Thr, Glu, Arg, Tyr, Cys, Pro, or Asp
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGLSKGCFGLKLDRIGSXSGLGC

SEQ ID NO: 531 - protein, 296 aa, Artificial Sequence
  Synthetic Construct (NC2B-22-X17  (w/ sig. seq.))
  MISC_FEATURE (291)..(291): Xaa can be any naturally occurring amino acid, including but not limited to Phe, Leu, Ile, Thr, Glu, Arg, Tyr, Cys, Pro, or Asp
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGLSKGCFGLKLDRIGSXSGLGC

SEQ ID NO: 532 - protein, 271 aa, Artificial Sequence
  Synthetic Construct (NC2B-22-X17 (w/o sig. seq.))
  MISC_FEATURE (266)..(266): Xaa can be any naturally occurring amino acid, including but not limited to Phe, Leu, Ile, Thr, Glu, Arg, Tyr, Cys, Pro, or Asp
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGLSKGCFGLKLDRIGSXSGLGC

SEQ ID NO: 533 - protein, 302 aa, Artificial Sequence
  Synthetic Construct (NC2B-28-X17 (w/ sig. seq.))
  MISC_FEATURE (297)..(297): Xaa can be any naturally occurring amino acid, including but not limited to Phe, Leu, Ile, Thr, Glu, Arg, Tyr, Cys, Pro, or Asp
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGLSKGCFGLKLDRIGSXSGLGC

SEQ ID NO: 534 - protein, 277 aa, Artificial Sequence
  Synthetic Construct (NC2B-28-X17 (w/o sig. seq.))
  MISC_FEATURE (272)..(272): Xaa can be any naturally occurring amino acid, including but not limited to Phe, Leu, Ile, Thr, Glu, Arg, Tyr, Cys, Pro, or Asp
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGLSKGCFGLKLDRIGSXSGLGC

SEQ ID NO: 535 - protein, 308 aa, Artificial Sequence
  Synthetic Construct (NC2B-34-X17 (w/ sig. seq.))
  MISC_FEATURE (303)..(303): Xaa can be any naturally occurring amino acid, including but not limited to Phe, Leu, Ile, Thr, Glu, Arg, Tyr, Cys, Pro, or Asp
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSGGGGGLSKGCFGLKLDRIGSXSGLGC

SEQ ID NO: 536 - protein, 283 aa, Artificial Sequence
  Synthetic Construct (NC2B-34-X17 (w/o sig. seq.))
  MISC_FEATURE (278)..(278): Xaa can be any naturally occurring amino acid
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSGGGGGLSKGCFGLKLDRIGSXSGLGC

SEQ ID NO: 537 - protein, 290 aa, Artificial Sequence
  Synthetic Construct (NC2-KGANKK-X17 (w/ sig. seq.))
  MISC_FEATURE (285)..(285): Xaa can be any naturally occurring amino acid, including but not limited to Phe, Leu, Ile, Thr, Glu, Arg, Tyr, Cys, Pro, or Asp
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANKKGLSKGCFGLKLDRIGSXSGLGC

SEQ ID NO: 538 - protein, 265 aa, Artificial Sequence
  Synthetic Construct (NC2-KGANKK-X17 (w/o sig. seq.))
  MISC_FEATURE (260)..(260): Xaa can be any naturally occurring amino acid, including but not limited to Phe, Leu, Ile, Thr, Glu, Arg, Tyr, Cys, Pro, or Asp
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANKKGLSKGCFGLKLDRIGSXSGLGC

SEQ ID NO: 539 - protein, 290 aa, Artificial Sequence
  Synthetic Construct (NC2-KGANQK-X17 (w/ sig. seq.))
  MISC_FEATURE (285)..(285): Xaa can be any naturally occurring amino acid, including but not limited to Phe, Leu, Ile, Thr, Glu, Arg, Tyr, Cys, Pro, or Asp
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANQKGLSKGCFGLKLDRIGSXSGLGC

SEQ ID NO: 540 - protein, 265 aa, Artificial Sequence
  Synthetic Construct (NC2-KGANQK-X17 (w/o sig. seq.))
  MISC_FEATURE (260)..(260): Xaa can be any naturally occurring amino acid, including but not limited to Phe, Leu, Ile, Thr, Glu, Arg, Tyr, Cys, Pro, or Asp
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANQKGLSKGCFGLKLDRIGSXSGLGC

SEQ ID NO: 541 - protein, 308 aa, Artificial Sequence
  Synthetic Construct (NC2-CNP53mut2-X17 (w/ sig. seq.))
  MISC_FEATURE (303)..(303): Xaa can be any naturally occurring amino acid, including but not limited to Phe, Leu, Ile, Thr, Glu, Arg, Tyr, Cys, Pro, or Asp
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLQVDTQSQAAWAQLLQEHPNAQQYKGANKKGLSKGCFGLKLDRIGSXSGLGC

SEQ ID NO: 542 - protein, 283 aa, Artificial Sequence
  Synthetic Construct (NC2-CNP53mut2-X17 (w/o sig. seq.))
  MISC_FEATURE (278)..(278): Xaa can be any naturally occurring amino acid, including but not limited to Phe, Leu, Ile, Thr, Glu, Arg, Tyr, Cys, Pro, or Asp
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLQVDTQSQAAWAQLLQEHPNAQQYKGANKKGLSKGCFGLKLDRIGSXSGLGC

SEQ ID NO: 543 - protein, 308 aa, Artificial Sequence
  Synthetic Construct (Fc-CNP53-X17 (w/ sig. seq.))
  MISC_FEATURE (303)..(303): Xaa can be any naturally occurring amino acid, including but not limited to Phe, Leu, Ile, Thr, Glu, Arg, Tyr, Cys, Pro, or Asp
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLRVDTKSRAAWARLLQEHPNARKYKGANKKGLSKGCFGLKLDRIGSXSGLGC

SEQ ID NO: 544 - protein, 283 aa, Artificial Sequence
  Synthetic Construct (Fc-CNP53-X17 (w/o sig. seq.))
  MISC_FEATURE (278)..(278): Xaa can be any naturally occurring amino acid, including but not limited to Phe, Leu, Ile, Thr, Glu, Arg, Tyr, Cys, Pro, or Asp
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLRVDTKSRAAWARLLQEHPNARKYKGANKKGLSKGCFGLKLDRIGSXSGLGC

SEQ ID NO: 545 - protein, 308 aa, Artificial Sequence
  Synthetic Construct (Fc-CNP53-AA-X17 (w/sig. seq.))
  MISC_FEATURE (303)..(303): Xaa can be any naturally occurring amino acid, including but not limited to Phe, Leu, Ile, Thr, Glu, Arg, Tyr, Cys, Pro, or Asp
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLRVDTKSRAAWARLLQEHPNARKYKGANAAGLSKGCFGLKLDRIGSXSGLGC

SEQ ID NO: 546 - protein, 283 aa, Artificial Sequence
  Synthetic Construct (Fc-CNP53-AA-X17 (w/o sig. seq.))
  MISC_FEATURE (278)..(278): Xaa can be any naturally occurring amino acid, including but not limited to Phe, Leu, Ile, Thr, Glu, Arg, Tyr, Cys, Pro, or Asp
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLRVDTKSRAAWARLLQEHPNARKYKGANAAGLSKGCFGLKLDRIGSXSGLGC

SEQ ID NO: 547 - protein, 285 aa, Artificial Sequence
  Synthetic Construct (CNP-X17-16AAlinker-Fc-His10 (NC1))
  MISC_FEATURE (17)..(17): Xaa can be any naturally occurring amino acid, including but not limited to Phe, Leu, Ile, Thr, Glu, Arg, Tyr, Cys, Pro, or Asp
GLSKGCFGLKLDRIGSXSGLGCGGGGSGGGGSGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGENLYFQGSHHHHHHHHHH

SEQ ID NO: 548 - protein, 275 aa, Artificial Sequence
  Synthetic Construct (CNP-X17-6AAlinker-Fc-His10 (NC3))
  MISC_FEATURE (17)..(17): Xaa can be any naturally occurring amino acid, including but not limited to Phe, Leu, Ile, Thr, Glu, Arg, Tyr, Cys, Pro, or Asp
GLSKGCFGLKLDRIGSXSGLGCGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGENLYFQGSHHHHHHHHHH

SEQ ID NO: 549 - protein, 255 aa, Artificial Sequence
  Synthetic Construct (CNP-X17-6AAlinker-Fc)
  MISC_FEATURE (17)..(17): Xaa can be any naturally occurring amino acid, including but not limited to Phe, Leu, Ile, Thr, Glu, Arg, Tyr, Cys, Pro, or Asp
GLSKGCFGLKLDRIGSXSGLGCGGGGSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 550 - protein, 264 aa, Artificial Sequence
  Synthetic Construct (CDNP-X17-Fc)
  MISC_FEATURE (17)..(17): Xaa can be any naturally occurring amino acid, including but not limited to Phe, Leu, Ile, Thr, Glu, Arg, Tyr, Cys, Pro, or Asp
GLSKGCFGLKLDRIGSXSGLGCPSLRDPRPNAPSTSADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 551 - protein, 264 aa, Artificial Sequence
  Synthetic Construct (CDNP-X17-saa-Fc)
  MISC_FEATURE (17)..(17): Xaa can be any naturally occurring amino acid, including but not limited to Phe, Leu, Ile, Thr, Glu, Arg, Tyr, Cys, Pro, or Asp
GLSKGCFGLKLDRIGSXSGLGCPSSAAPRPNAPSTSADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 552 - protein, 264 aa, Artificial Sequence
  Synthetic Construct (CDNP-X17-sra-Fc)
  MISC_FEATURE (17)..(17): Xaa can be any naturally occurring amino acid, including but not limited to Phe, Leu, Ile, Thr, Glu, Arg, Tyr, Cys, Pro, or Asp
GLSKGCFGLKLDRIGSXSGLGCPSSRAPRPNAPSTSADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 553 - protein, 300 aa, Artificial Sequence
  Synthetic Construct (D10-NC2-KGANKK (w/sig. seq.))
MGVHECPAWLWLLLSLLSLWPGAYADDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANKKGLSKGCFGLKLDRIGSMSGLGC

SEQ ID NO: 554 - protein, 275 aa, Artificial Sequence
  Synthetic Construct (D10-NC2-KGANKK (w/o sig. seq.))
DDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANKKGLSKGCFGLKLDRIGSMSGLGC

SEQ ID NO: 555 - protein, 300 aa, Artificial Sequence
  Synthetic Construct (D10-NC2-KGANQK (w/sig. seq.))
MGVHECPAWLWLLLSLLSLWPGAYADDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANQKGLSKGCFGLKLDRIGSMSGLGC

SEQ ID NO: 556 - protein, 275 aa, Artificial Sequence
  Synthetic Construct (D10-NC2-KGANQK (w/o sig. seq.))
DDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANQKGLSKGCFGLKLDRIGSMSGLGC

SEQ ID NO: 557 - protein, 318 aa, Artificial Sequence
  Synthetic Construct (D10-NC2-CNP53mut2 (w/sig. seq.))
MGVHECPAWLWLLLSLLSLWPGAYADDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLQVDTQSQAAWAQLLQEHPNAQQYKGANKKGLSKGCFGLKLDRIGSMSGLGC

SEQ ID NO: 558 - protein, 293 aa, Artificial Sequence
  Synthetic Construct (D10-NC2-CNP53mut2 (w/o sig. seq.))
DDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLQVDTQSQAAWAQLLQEHPNAQQYKGANKKGLSKGCFGLKLDRIGSMSGLGC

SEQ ID NO: 559 - protein, 290 aa, Artificial Sequence
  Synthetic Construct (NC2-KGANKK-F17 (w/sig. seq.))
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANKKGLSKGCFGLKLDRIGSFSGLGC

SEQ ID NO: 560 - protein, 265 aa, Artificial Sequence
  Synthetic Construct (NC2-KGANKK-F17 (w/o sig. seq.))
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANKKGLSKGCFGLKLDRIGSFSGLGC

SEQ ID NO: 561 - protein, 290 aa, Artificial Sequence
  Synthetic Construct (NC2-KGANQK-F17 (w/sig. seq.))
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANQKGLSKGCFGLKLDRIGSFSGLGC

SEQ ID NO: 562 - protein, 265 aa, Artificial Sequence
  Synthetic Construct (NC2-KGANQK-F17 (w/o sig. seq.))
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANQKGLSKGCFGLKLDRIGSFSGLGC

SEQ ID NO: 563 - protein, 308 aa, Artificial Sequence
  Synthetic Construct (NC2-CNP53mut2-F17 (w/sig. seq.))
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLQVDTQSQAAWAQLLQEHPNAQQYKGANKKGLSKGCFGLKLDRIGSFSGLGC

SEQ ID NO: 564 - protein, 283 aa, Artificial Sequence
  Synthetic Construct (NC2-CNP53mut2-F17 (w/o sig. seq.))
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLQVDTQSQAAWAQLLQEHPNAQQYKGANKKGLSKGCFGLKLDRIGSFSGLGC

SEQ ID NO: 565 - protein, 300 aa, Artificial Sequence
  Synthetic Construct (D10-NC2-KGANKK-F17 (w/sig. seq.))
MGVHECPAWLWLLLSLLSLWPGAYADDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANKKGLSKGCFGLKLDRIGSFSGLGC

SEQ ID NO: 566 - protein, 275 aa, Artificial Sequence
  Synthetic Construct (D10-NC2-KGANKK-F17 (w/o sig. seq.))
DDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANKKGLSKGCFGLKLDRIGSFSGLGC

SEQ ID NO: 567 - protein, 300 aa, Artificial Sequence
  Synthetic Construct (D10-NC2-KGANQK-F17 (w/sig. seq.))
MGVHECPAWLWLLLSLLSLWPGAYADDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANQKGLSKGCFGLKLDRIGSFSGLGC

SEQ ID NO: 568 - protein, 275 aa, Artificial Sequence
  Synthetic Construct (D10-NC2-KGANQK-F17 (w/o sig. seq.))
DDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANQKGLSKGCFGLKLDRIGSFSGLGC

SEQ ID NO: 569 - protein, 318 aa, Artificial Sequence
  Synthetic Construct (D10-NC2-CNP53mut2-F17 (w/sig. seq.))
MGVHECPAWLWLLLSLLSLWPGAYADDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLQVDTQSQAAWAQLLQEHPNAQQYKGANKKGLSKGCFGLKLDRIGSFSGLGC

SEQ ID NO: 570 - protein, 293 aa, Artificial Sequence
  Synthetic Construct (D10-NC2-CNP53mut2-F17 (w/o sig. seq.))
DDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLQVDTQSQAAWAQLLQEHPNAQQYKGANKKGLSKGCFGLKLDRIGSFSGLGC

SEQ ID NO: 571 - protein, 290 aa, Artificial Sequence
  Synthetic Construct (NC2-KGANKK-L17 (w/sig. seq.))
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANKKGLSKGCFGLKLDRIGSLSGLGC

SEQ ID NO: 572 - protein, 265 aa, Artificial Sequence
  Synthetic Construct (NC2-KGANKK-L17 (w/o sig. seq.))
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANKKGLSKGCFGLKLDRIGSLSGLGC

SEQ ID NO: 573 - protein, 290 aa, Artificial Sequence
  Synthetic Construct (NC2-KGANQK-L17 (w/sig. seq.))
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANQKGLSKGCFGLKLDRIGSLSGLGC

SEQ ID NO: 574 - protein, 265 aa, Artificial Sequence
  Synthetic Construct (NC2-KGANQK-L17 (w/o sig. seq.))
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANQKGLSKGCFGLKLDRIGSLSGLGC

SEQ ID NO: 575 - protein, 308 aa, Artificial Sequence
  Synthetic Construct (NC2-CNP53mut2-L17 (w/sig. seq.))
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLQVDTQSQAAWAQLLQEHPNAQQYKGANKKGLSKGCFGLKLDRIGSLSGLGC

SEQ ID NO: 576 - protein, 283 aa, Artificial Sequence
  Synthetic Construct (NC2-CNP53mut2-L17 (w/o sig. seq.))
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLQVDTQSQAAWAQLLQEHPNAQQYKGANKKGLSKGCFGLKLDRIGSLSGLGC

SEQ ID NO: 577 - protein, 300 aa, Artificial Sequence
  Synthetic Construct (D10-NC2-KGANKK-L17 (w/sig. seq.))
MGVHECPAWLWLLLSLLSLWPGAYADDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANKKGLSKGCFGLKLDRIGSLSGLGC

SEQ ID NO: 578 - protein, 275 aa, Artificial Sequence
  Synthetic Construct (D10-NC2-KGANKK-L17 (w/o sig. seq.))
DDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANKKGLSKGCFGLKLDRIGSLSGLGC

SEQ ID NO: 579 - protein, 300 aa, Artificial Sequence
  Synthetic Construct (D10-NC2-KGANQK-L17 (w/sig. seq.))
MGVHECPAWLWLLLSLLSLWPGAYADDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANQKGLSKGCFGLKLDRIGSLSGLGC

SEQ ID NO: 580 - protein, 275 aa, Artificial Sequence
  Synthetic Construct (D10-NC2-KGANQK-L17 (w/o sig. seq.))
DDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANQKGLSKGCFGLKLDRIGSLSGLGC

SEQ ID NO: 581 - protein, 318 aa, Artificial Sequence
  Synthetic Construct (D10-NC2-CNP53mut2-L17 (w/sig. seq.))
MGVHECPAWLWLLLSLLSLWPGAYADDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLQVDTQSQAAWAQLLQEHPNAQQYKGANKKGLSKGCFGLKLDRIGSLSGLGC

SEQ ID NO: 582 - protein, 293 aa, Artificial Sequence
  Synthetic Construct (D10-NC2-CNP53mut2-L17 (w/o sig. seq.))
DDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLQVDTQSQAAWAQLLQEHPNAQQYKGANKKGLSKGCFGLKLDRIGSLSGLGC

SEQ ID NO: 583 - protein, 290 aa, Artificial Sequence
  Synthetic Construct (NC2-KGANKK-R17 (w/sig. seq.))
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANKKGLSKGCFGLKLDRIGSRSGLGC

SEQ ID NO: 584 - protein, 265 aa, Artificial Sequence
  Synthetic Construct (NC2-KGANKK-R17 (w/o sig. seq.))
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANKKGLSKGCFGLKLDRIGSRSGLGC

SEQ ID NO: 585 - protein, 290 aa, Artificial Sequence
  Synthetic Construct (NC2-KGANQK-R17 (w/sig. seq.))
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANQKGLSKGCFGLKLDRIGSRSGLGC

SEQ ID NO: 586 - protein, 265 aa, Artificial Sequence
  Synthetic Construct (NC2-KGANQK-R17 (w/o sig. seq.))
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANQKGLSKGCFGLKLDRIGSRSGLGC

SEQ ID NO: 587 - protein, 308 aa, Artificial Sequence
  Synthetic Construct (NC2-CNP53mut2-R17 (w/sig. seq.))
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLQVDTQSQAAWAQLLQEHPNAQQYKGANKKGLSKGCFGLKLDRIGSRSGLGC

SEQ ID NO: 588 - protein, 283 aa, Artificial Sequence
  Synthetic Construct (NC2-CNP53mut2-R17 (w/o sig. seq.))
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLQVDTQSQAAWAQLLQEHPNAQQYKGANKKGLSKGCFGLKLDRIGSRSGLGC

SEQ ID NO: 589 - protein, 300 aa, Artificial Sequence
  Synthetic Construct (D10-NC2-KGANKK-R17 (w/sig. seq.))
MGVHECPAWLWLLLSLLSLWPGAYADDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANKKGLSKGCFGLKLDRIGSRSGLGC

SEQ ID NO: 590 - protein, 275 aa, Artificial Sequence
  Synthetic Construct (D10-NC2-KGANKK-R17 (w/o sig. seq.))
DDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANKKGLSKGCFGLKLDRIGSRSGLGC

SEQ ID NO: 591 - protein, 300 aa, Artificial Sequence
  Synthetic Construct (D10-NC2-KGANQK-R17 (w/sig. seq.))
MGVHECPAWLWLLLSLLSLWPGAYADDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANQKGLSKGCFGLKLDRIGSRSGLGC

SEQ ID NO: 592 - protein, 275 aa, Artificial Sequence
  Synthetic Construct (D10-NC2-KGANQK-R17 (w/o sig. seq.))
DDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANQKGLSKGCFGLKLDRIGSRSGLGC

SEQ ID NO: 593 - protein, 318 aa, Artificial Sequence
  Synthetic Construct (D10-NC2-CNP53mut2-R17 (w/sig. seq.))
MGVHECPAWLWLLLSLLSLWPGAYADDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLQVDTQSQAAWAQLLQEHPNAQQYKGANKKGLSKGCFGLKLDRIGSRSGLGC

SEQ ID NO: 594 - protein, 293 aa, Artificial Sequence
  Synthetic Construct (D10-NC2-CNP53mut2-R17 (w/o sig. seq.))
DDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLQVDTQSQAAWAQLLQEHPNAQQYKGANKKGLSKGCFGLKLDRIGSRSGLGC

SEQ ID NO: 595 - protein, 290 aa, Artificial Sequence
  Synthetic Construct (NC2-KGANKK-Y17 (w/sig. seq.))
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANKKGLSKGCFGLKLDRIGSYSGLGC

SEQ ID NO: 596 - protein, 265 aa, Artificial Sequence
  Synthetic Construct (NC2-KGANKK-Y17 (w/o sig. seq.))
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANKKGLSKGCFGLKLDRIGSYSGLGC

SEQ ID NO: 597 - protein, 290 aa, Artificial Sequence
  Synthetic Construct (NC2-KGANQK-Y17 (w/sig. seq.))
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANQKGLSKGCFGLKLDRIGSYSGLGC

SEQ ID NO: 598 - protein, 265 aa, Artificial Sequence
  Synthetic Construct (NC2-KGANQK-Y17 (w/o sig. seq.))
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANQKGLSKGCFGLKLDRIGSYSGLGC

SEQ ID NO: 599 - protein, 308 aa, Artificial Sequence
  Synthetic Construct (NC2-CNP53mut2-Y17 (w/sig. seq.))
MGVHECPAWLWLLLSLLSLWPGAYADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLQVDTQSQAAWAQLLQEHPNAQQYKGANKKGLSKGCFGLKLDRIGSYSGLGC

SEQ ID NO: 600 - protein, 283 aa, Artificial Sequence
  Synthetic Construct (NC2-CNP53mut2-Y17 (w/o sig. seq.))
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLQVDTQSQAAWAQLLQEHPNAQQYKGANKKGLSKGCFGLKLDRIGSYSGLGC

SEQ ID NO: 601 - protein, 300 aa, Artificial Sequence
  Synthetic Construct (D10-NC2-KGANKK-Y17 (w/sig. seq.))
MGVHECPAWLWLLLSLLSLWPGAYADDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANKKGLSKGCFGLKLDRIGSYSGLGC

SEQ ID NO: 602 - protein, 275 aa, Artificial Sequence
  Synthetic Construct (D10-NC2-KGANKK-Y17 (w/o sig. seq.))
DDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANKKGLSKGCFGLKLDRIGSYSGLGC

SEQ ID NO: 603 - protein, 300 aa, Artificial Sequence
  Synthetic Construct (D10-NC2-KGANQK-Y17 (w/sig. seq.))
MGVHECPAWLWLLLSLLSLWPGAYADDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANQKGLSKGCFGLKLDRIGSYSGLGC

SEQ ID NO: 604 - protein, 275 aa, Artificial Sequence
  Synthetic Construct (D10-NC2-KGANQK-Y17 (w/o sig. seq.))
DDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSKGANQKGLSKGCFGLKLDRIGSYSGLGC

SEQ ID NO: 605 - protein, 318 aa, Artificial Sequence
  Synthetic Construct (D10-NC2-CNP53mut2-Y17 (w/sig. seq.))
MGVHECPAWLWLLLSLLSLWPGAYADDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLQVDTQSQAAWAQLLQEHPNAQQYKGANKKGLSKGCFGLKLDRIGSYSGLGC

SEQ ID NO: 606 - protein, 293 aa, Artificial Sequence
  Synthetic Construct (D10-NC2-CNP53mut2-Y17 (w/o sig. seq.))
DDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGDLQVDTQSQAAWAQLLQEHPNAQQYKGANKKGLSKGCFGLKLDRIGSYSGLGC

SEQ ID NO: 607 - protein, 300 aa, Artificial Sequence
  Synthetic Construct (D10-NC2 (w/sig. seq.))
MGVHECPAWLWLLLSLLSLWPGAYADDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGLSKGCFGLKLDRIGSMSGLGC

SEQ ID NO: 608 - protein, 275 aa, Artificial Sequence
  Synthetic Construct (D10-NC2 (w/o sig. seq.))
DDDDDDDDDDDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGLSKGCFGLKLDRIGSMSGLGC

SEQ ID NO: 609-800 - skipped (192 entries)

SEQ ID NO: 801 - DNA, 945 bp, Artificial Sequence
  NC2st DNA Sequence
atgggcgtgcacgagtgtcctgcctggctgtggctgctgctgagcctgctgtctctgtggcctggcgcctacgccgcctcttggagccacccccagtttgagcagtctggcggcggaggaggcgagaacctgtactttcagggcggcgacaagacccacacctgtcccccttgtcctgcccctgagctgctgggcggacccagcgtgttcctgttccccccaaagcccaaggacaccctgatgatcagccggacccccgaagtgacctgcgtggtggtggacgtgtcccacgaggaccctgaagtgaagttcaattggtacgtggacggcgtggaggtgcacaacgccaagaccaagccccgggaggaacagtacaacagcacctaccgggtggtgtccgtgctgaccgtgctgcaccaggactggctgaacggcaaagagtacaagtgcaaggtctccaacaaggccctgcctgcccccatcgagaaaaccatcagcaaggccaagggccagcccagagaaccccaggtgtacaccctgccccccagccgggaggaaatgaccaagaaccaggtgtccctgacctgcctggtgaagggcttctaccccagcgatatcgccgtggagtgggagagcaacggccagcctgagaacaactacaagaccaccccccctgtgctggacagcgacggaagcttcttcctgtactccaaactgaccgtggacaagagccggtggcagcagggcaacgtgttcagctgcagcgtgatgcacgaggccctgcacaaccactacacccagaagtccctgagcctgtctcctggcaagggcggagggggaagtggaggcggaggaagcgggggaggcggaagcggcggactgagcaagggctgcttcggcctgaagctggaccggatcggcagcatgagcggcctgggctgctga

SEQ ID NO: 802 - DNA, 873 bp, Artificial Sequence
  NC2B DNA Sequence
atgggcgtgcacgagtgtcctgcctggctgtggctgctgctgagcctgctgtctctgtggcctggcgcctacgccgacaagacccacacctgtcccccttgtcctgcccctgagctgctgggcggacccagcgtgttcctgttccccccaaagcccaaggacaccctgatgatcagccggacccccgaagtgacctgcgtggtggtggacgtgtcccacgaggaccctgaagtgaagttcaattggtacgtggacggcgtggaggtgcacaacgccaagaccaagccccgggaggaacagtacaacagcacctaccgggtggtgtccgtgctgaccgtgctgcaccaggactggctgaacggcaaagagtacaagtgcaaggtctccaacaaggccctgcctgcccccatcgagaaaaccatcagcaaggccaagggccagcccagagaaccccaggtgtacaccctgccccccagccgggaggaaatgaccaagaaccaggtgtccctgacctgcctggtgaagggcttctaccccagcgatatcgccgtggagtgggagagcaacggccagcctgagaacaactacaagaccaccccccctgtgctggacagcgacggcagcttcttcctgtactccaaactgaccgtggacaagagccggtggcagcagggcaacgtgttcagctgcagcgtgatgcacgaggccctgcacaaccactacacccagaagtccctgagcctgtctcctggcaagggcggagggggaagtggaggcggaggaagcgggggaggcggaagcggcggactgagcaagggctgcttcggcctgaagctggaccggatcggcagcatgagcggcctgggctgctga

SEQ ID NO: 803 - DNA, 891 bp, Artificial Sequence
  NC2B-22 DNA Sequence
atgggcgtgcacgagtgtcctgcctggctgtggctgctgctgagcctgctgtctctgtggcctggcgcctacgccgacaagacccacacctgtcccccttgtcctgcccctgagctgctgggcggacccagcgtgttcctgttccccccaaagcccaaggacaccctgatgatcagccggacccccgaagtgacctgcgtggtggtggacgtgtcccacgaggaccctgaagtgaagttcaattggtacgtggacggcgtggaggtgcacaacgccaagaccaagccccgggaggaacagtacaacagcacctaccgggtggtgtccgtgctgaccgtgctgcaccaggactggctgaacggcaaagagtacaagtgcaaggtctccaacaaggccctgcctgcccccatcgagaaaaccatcagcaaggccaagggccagcccagagaaccccaggtgtacaccctgccccccagccgggaggaaatgaccaagaaccaggtgtccctgacctgcctggtgaagggcttctaccccagcgatatcgccgtggagtgggagagcaacggccagcctgagaacaactacaagaccaccccccctgtgctggacagcgacggcagcttcttcctgtactccaaactgaccgtggacaagagccggtggcagcagggcaacgtgttcagctgcagcgtgatgcacgaggccctgcacaaccactacacccagaagtccctgagcctgtctcctggcaagggcggagggggaagtggaggcggaggaagcgggggaggcggaagcggaggcggaggatctggcggcggactgagcaagggctgcttcggcctgaagctggaccggatcggcagcatgagcggcctgggctgctga

SEQ ID NO: 804 - DNA, 909 bp, Artificial Sequence
  NC2B-28 DNA Sequence
atgggcgtgcacgagtgtcctgcctggctgtggctgctgctgagcctgctgtctctgtggcctggcgcctacgccgacaagacccacacctgtcccccttgtcctgcccctgagctgctgggcggacccagcgtgttcctgttccccccaaagcccaaggacaccctgatgatcagccggacccccgaagtgacctgcgtggtggtggacgtgtcccacgaggaccctgaagtgaagttcaattggtacgtggacggcgtggaggtgcacaacgccaagaccaagccccgggaggaacagtacaacagcacctaccgggtggtgtccgtgctgaccgtgctgcaccaggactggctgaacggcaaagagtacaagtgcaaggtctccaacaaggccctgcctgcccccatcgagaaaaccatcagcaaggccaagggccagcccagagaaccccaggtgtacaccctgccccccagccgggaggaaatgaccaagaaccaggtgtccctgacctgcctggtgaagggcttctaccccagcgatatcgccgtggagtgggagagcaacggccagcctgagaacaactacaagaccaccccccctgtgctggacagcgacggcagcttcttcctgtactccaaactgaccgtggacaagagccggtggcagcagggcaacgtgttcagctgcagcgtgatgcacgaggccctgcacaaccactacacccagaagtccctgagcctgtctcctggcaagggcggagggggaagtggaggcggaggaagcgggggaggcggaagcggaggcggaggatctggcggcggaggaagtggcggaggcggactgagcaagggctgcttcggcctgaagctggaccggatcggcagcatgagcggcctgggctgctga

SEQ ID NO: 805 - DNA, 927 bp, Artificial Sequence
  NC2B-34 DNA Sequence
atgggcgtgcacgagtgtcctgcctggctgtggctgctgctgagcctgctgtctctgtggcctggcgcctacgccgacaagacccacacctgtcccccttgtcctgcccctgagctgctgggcggacccagcgtgttcctgttccccccaaagcccaaggacaccctgatgatcagccggacccccgaagtgacctgcgtggtggtggacgtgtcccacgaggaccctgaagtgaagttcaattggtacgtggacggcgtggaggtgcacaacgccaagaccaagccccgggaggaacagtacaacagcacctaccgggtggtgtccgtgctgaccgtgctgcaccaggactggctgaacggcaaagagtacaagtgcaaggtctccaacaaggccctgcctgcccccatcgagaaaaccatcagcaaggccaagggccagcccagagaaccccaggtgtacaccctgccccccagccgggaggaaatgaccaagaaccaggtgtccctgacctgcctggtgaagggcttctaccccagcgatatcgccgtggagtgggagagcaacggccagcctgagaacaactacaagaccaccccccctgtgctggacagcgacggcagcttcttcctgtactccaaactgaccgtggacaagagccggtggcagcagggcaacgtgttcagctgcagcgtgatgcacgaggccctgcacaaccactacacccagaagtccctgagcctgtctcctggcaagggcggagggggaagtggaggcggaggaagcgggggaggcggaagcggaggcggaggatctggcggcggaggaagtggcggaggcggcagcggcggagggggaggactgagcaagggctgcttcggcctgaagctggaccggatcggcagcatgagcggcctgggctgctga

SEQ ID NO: 806 - DNA, 933 bp, Artificial Sequence
  NC1 DNA Sequence
atgggcgtgcacgagtgtcctgcctggctgtggctgctgctgagcctgctgtctctgtggcctggcgcctacgccggcctgagcaagggctgcttcggcctgaagctggaccggatcggcagcatgtctggcctgggctgtggaggcggaggatctggcggcggaggaagtggcggaggcggcagcggcgataagacccacacctgtcccccttgtcctgcccctgagctgctgggcggacccagcgtgttcctgttccccccaaagcccaaggacaccctgatgatcagccggacccccgaagtgacctgcgtggtggtggacgtgtcccacgaggaccctgaagtgaagttcaattggtacgtggacggcgtggaggtgcacaacgccaagaccaagccccgggaggaacagtacaacagcacctaccgggtggtgtccgtgctgaccgtgctgcaccaggactggctgaacggcaaagagtacaagtgcaaggtctccaacaaggccctgcctgcccccatcgagaaaaccatcagcaaggccaagggccagcccagagaaccccaggtgtacaccctgccccccagccgggaggaaatgaccaagaaccaggtgtccctgacctgcctggtgaagggcttctaccccagcgatatcgccgtggagtgggagagcaacggccagcctgagaacaactacaagaccaccccccctgtgctggacagcgacggcagcttcttcctgtactccaaactgaccgtggacaagagccggtggcagcagggcaacgtgttcagctgcagcgtgatgcacgaggccctgcacaaccactacacccagaagtccctgagcctgtctcctggcaagggcggcgagaacctgtactttcagggcagccaccaccatcaccatcaccaccatcatcactga

SEQ ID NO: 807-1000 - skipped (194 entries)

SEQ ID NO: 1001 - protein, 54 aa, Artificial Sequence
  Synthetic construct (additional CNP variant)
GDLRVDTKSRAAWARLLQEHPNARKYKGANKKGLSKGCFGLKLDRIGSMSGLGC

SEQ ID NO: 1002 - protein, 54 aa, Artificial Sequence
  Synthetic construct (additional CNP variant)
PDLRVDTKSRAAWARLLQEHPNARKYKGANKKGLSKGCFGLKLDRIGSMSGLGC

SEQ ID NO: 1003 - protein, 54 aa, Artificial Sequence
  Synthetic construct (additional CNP variant)
MDLRVDTKSRAAWARLLQEHPNARKYKGANKKGLSKGCFGLKLDRIGSMSGLGC

SEQ ID NO: 1004 - protein, 53 aa, Artificial Sequence
  Synthetic construct (additional CNP variant)
DLRVDTKSRAAWARLLQEHPNARKYKGANKKGLSKGCFGLKLDRIGSNSGLGC

SEQ ID NO: 1005 - protein, 52 aa, Artificial Sequence
  Synthetic construct (additional CNP variant)
LRVDTKSRAAWARLLQEHPNARKYKGANKKGLSKGCFGLKLDRIGSMSGLGC

SEQ ID NO: 1006 - protein, 51 aa, Artificial Sequence
  Synthetic construct (additional CNP variant)
RVDTKSRAAWARLLQEHPNARKYKGANKKGLSKGCFGLKLDRIGSMSGLGC

SEQ ID NO: 1007 - protein, 50 aa, Artificial Sequence
  Synthetic construct (additional CNP variant)
VDTKSRAAWARLLQEHPNARKYKGANKKGLSKGCFGLKLDRIGSMSGLGC

SEQ ID NO: 1008 - protein, 49 aa, Artificial Sequence
  Synthetic construct (additional CNP variant)
DTKSRAAWARLLQEHPNARKYKGANKKGLSKGCFGLKLDRIGSMSGLGC

SEQ ID NO: 1009 - protein, 48 aa, Artificial Sequence
  Synthetic construct (additional CNP variant)
TKSRAAWARLLQEHPNARKYKGANKKGLSKGCFGLKLDRIGSMSGLGC

SEQ ID NO: 1010 - protein, 47 aa, Artificial Sequence
  Synthetic construct (additional CNP variant)
KSRAAWARLLQEHPNARKYKGANKKGLSKGCFGLKLDRIGSMSGLGC

SEQ ID NO: 1011 - protein, 46 aa, Artificial Sequence
  Synthetic construct (additional CNP variant)
SRAAWARLLQEHPNARKYKGANKKGLSKGCFGLKLDRIGSMSGLGC

SEQ ID NO: 1012 - protein, 45 aa, Artificial Sequence
  Synthetic construct (additional CNP variant)
RAAWARLLQEHPNARKYKGANKKGLSKGCFGLKLDRIGSMSGLGC

SEQ ID NO: 1013 - protein, 44 aa, Artificial Sequence
  Synthetic construct (additional CNP variant)
AAWARLLQEHPNARKYKGANKKGLSKGCFGLKLDRIGSMSGLGC

SEQ ID NO: 1014 - protein, 43 aa, Artificial Sequence
  Synthetic construct (additional CNP variant)
AWARLLQEHPNARKYKGANKKGLSKGCFGLKLDRIGSMSGLGC

SEQ ID NO: 1015 - protein, 42 aa, Artificial Sequence
  Synthetic construct (additional CNP variant)
WARLLQEHPNARKYKGANKKGLSKGCFGLKLDRIGSMSGLGC

SEQ ID NO: 1016 - protein, 41 aa, Artificial Sequence
  Synthetic construct (additional CNP variant)
ARLLQEHPNARKYKGANKKGLSKGCFGLKLDRIGSMSGLGC

SEQ ID NO: 1017 - protein, 40 aa, Artificial Sequence
  Synthetic construct (additional CNP variant)
RLLQEHPNARKYKGANKKGLSKGCFGLKLDRIGSMSGLGC

SEQ ID NO: 1018 - protein, 39 aa, Artificial Sequence
  Synthetic construct (additional CNP variant)
LLQEHPNARKYKGANKKGLSKGCFGLKLDRIGSMSGLGC

SEQ ID NO: 1019 - protein, 38 aa, Artificial Sequence
  Synthetic construct (additional CNP variant)
LQEHPNARKYKGANKKGLSKGCFGLKLDRIGSMSGLGC

SEQ ID NO: 1020 - protein, 36 aa, Artificial Sequence
  Synthetic construct (additional CNP variant)
EHPNARKYKGANKKGLSKGCFGLKLDRIGSMSGLGC

SEQ ID NO: 1021 - protein, 35 aa, Artificial Sequence
  Synthetic construct (additional CNP variant)
HPNARKYKGANKKGLSKGCFGLKLDRIGSMSGLGC

SEQ ID NO: 1022 - protein, 34 aa, Artificial Sequence
  Synthetic construct (additional CNP variant)
PNARKYKGANKKGLSKGCFGLKLDRIGSMSGLGC

SEQ ID NO: 1023 - protein, 33 aa, Artificial Sequence
  Synthetic construct (additional CNP variant)
NARKYKGANKKGLSKGCFGLKLDRIGSMSGLGC

SEQ ID NO: 1024 - protein, 32 aa, Artificial Sequence
  Synthetic construct (additional CNP variant)
ARKYKGANKKGLSKGCFGLKLDRIGSMSGLGC

SEQ ID NO: 1025 - protein, 31 aa, Artificial Sequence
  Synthetic construct (additional CNP variant)
RKYKGANKKGLSKGCFGLKLDRIGSMSGLGC

SEQ ID NO: 1026 - protein, 30 aa, Artificial Sequence
  Synthetic construct (additional CNP variant)
KYKGANKKGLSKGCFGLKLDRIGSMSGLGC

SEQ ID NO: 1027 - protein, 29 aa, Artificial Sequence
  Synthetic construct (additional CNP variant)
YKGANKKGLSKGCFGLKLDRIGSMSGLGC

SEQ ID NO: 1028 - protein, 28 aa, Artificial Sequence
  Synthetic construct (additional CNP variant)
KGANKKGLSKGCFGLKLDRIGSMSGLGC

SEQ ID NO: 1029 - protein, 27 aa, Artificial Sequence
  Synthetic construct (additional CNP variant)
GANKKGLSKGCFGLKLDRIGSMSGLGC

SEQ ID NO: 1030 - protein, 26 aa, Artificial Sequence
  Synthetic construct (additional CNP variant)
ANKKGLSKGCFGLKLDRIGSMSGLGC

SEQ ID NO: 1031 - protein, 25 aa, Artificial Sequence
  Synthetic construct (additional CNP variant)
NKKGLSKGCFGLKLDRIGSMSGLGC

SEQ ID NO: 1032 - protein, 24 aa, Artificial Sequence
  Synthetic construct (additional CNP variant)
KKGLSKGCFGLKLDRIGSMSGLGC

SEQ ID NO: 1033 - protein, 23 aa, Artificial Sequence
  Synthetic construct (additional CNP variant)
KGLSKGCFGLKLDRIGSMSGLGC

SEQ ID NO: 1034 - protein, 21 aa, Artificial Sequence
  Synthetic construct (additional CNP variant)
LSKGCFGLKLDRIGSMSGLGC

SEQ ID NO: 1035 - protein, 20 aa, Artificial Sequence
  Synthetic construct (additional CNP variant)
SKGCFGLKLDRIGSMSGLGC

SEQ ID NO: 1036 - protein, 19 aa, Artificial Sequence
  Synthetic construct (additional CNP variant)
KGCFGLKLDRIGSMSGLGC

SEQ ID NO: 1037 - protein, 18 aa, Artificial Sequence
  Synthetic construct (additional CNP variant)
GCFGLKLDRIGSMSGLGC

SEQ ID NO: 1038 - protein, 37 aa, Artificial Sequence
  Synthetic construct (additional CNP variant)
QEHPNARKYKGANKKGLSKGCFGLKLDRIGSNSGLGC

SEQ ID NO: 1039 - protein, 38 aa, Artificial Sequence
  Synthetic construct (additional CNP variant)
PQEHPNARKYKGANKKGLSKGCFGLKLDRIGSMSGLGC

SEQ ID NO: 1040 - protein, 38 aa, Artificial Sequence
  Synthetic construct (additional CNP variant)
MQEHPNARKYKGANKKGLSKGCFGLKLDRIGSMSGLGC

SEQ ID NO: 1041 - protein, 38 aa, Artificial Sequence
  Synthetic construct (additional CNP variant)
GQEHPNARKYKGANKKGLSKGCFGLKLDRIGSMSGLGC

SEQ ID NO: 1042 - protein, 38 aa, Artificial Sequence
  Synthetic construct (additional CNP variant)
GQEHPNARKYKGANPKGLSKGCFGLKLDRIGSMSGLGC

SEQ ID NO: 1043 - protein, 38 aa, Artificial Sequence
  Synthetic construct (additional CNP variant)
GQEHPNARKYKGANQKGLSKGCFGLKLDRIGSMSGLGC

SEQ ID NO: 1044 - protein, 38 aa, Artificial Sequence
  Synthetic construct (additional CNP variant)
GQEHPNARKYKGANQQGLSKGCFGLKLDRIGSMSGLGC

SEQ ID NO: 1045 - protein, 38 aa, Artificial Sequence
  Synthetic construct (additional CNP variant)
GQEHPNARKYKGANKPGLSKGCFGLKLDRIGSMSGLGC

SEQ ID NO: 1046 - protein, 38 aa, Artificial Sequence
  Synthetic construct (additional CNP variant)
GQEHPNARKYKGANKKGLSKGCFGLKLDRIGSNSGLGC

SEQ ID NO: 1047 - protein, 39 aa, Artificial Sequence
  Synthetic construct (additional CNP variant)
PGQEHPNARKYKGANKKGLSKGCFGLKLDRIGSMSGLGC

SEQ ID NO: 1048 - protein, 39 aa, Artificial Sequence
  Synthetic construct (additional CNP variant)
MGQEHPNARKYKGANKKGLSKGCFGLKLDRIGSMSGLGC

SEQ ID NO: 1049 - protein, 27 aa, Artificial Sequence
  Synthetic construct (additional CNP variant)
GANRRGLSRGCFGLKLDRIGSMSGLGC

SEQ ID NO: 1050 - protein, 27 aa, Artificial Sequence
  Synthetic construct (additional CNP variant)
GANRRGLSRGCFGLKLDRIGSNSGLGC

SEQ ID NO: 1051 - protein, 28 aa, Artificial Sequence
  Synthetic construct (additional CNP variant)
PGANRRGLSRGCFGLKLDRIGSMSGLGC

SEQ ID NO: 1052 - protein, 28 aa, Artificial Sequence
  Synthetic construct (additional CNP variant)
MGANRRGLSRGCFGLKLDRIGSMSGLGC

SEQ ID NO: 1053 - protein, 38 aa, Artificial Sequence
  Synthetic construct (additional CNP variant)
GHKSEVAHRFKGANKKGLSKGCFGLKLDRIGSMSGLGC

SEQ ID NO: 1054 - protein, 38 aa, Artificial Sequence
  Synthetic construct (additional CNP variant)
GHKSEVAHRFKGANKKGLSKGCFGLKLDRIGSNSGLGC

SEQ ID NO: 1055 - protein, 39 aa, Artificial Sequence
  Synthetic construct (additional CNP variant)
PGHKSEVAHRFKGANKKGLSKGCFGLKLDRIGSMSGLGC

SEQ ID NO: 1056 - protein, 39 aa, Artificial Sequence
  Synthetic construct (additional CNP variant)
MGHKSEVAHRFKGANKKGLSKGCFGLKLDRIGSMSGLGC

SEQ ID NO: 1057 - protein, 23 aa, Artificial Sequence
  Synthetic construct (additional CNP variant)
RGLSRGCFGLKLDRIGSMSGLGC

SEQ ID NO: 1058 - protein, 24 aa, Artificial Sequence
  Synthetic construct (additional CNP variant)
ERGLSRGCFGLKLDRIGSMSGLGC

SEQ ID NO: 1059 - protein, 27 aa, Artificial Sequence
  Synthetic construct (additional CNP variant)
GANQQGLSKGCFGLKLDRIGSMSGLGC

SEQ ID NO: 1060 - protein, 27 aa, Artificial Sequence
  Synthetic construct (additional CNP variant)
GANRRGLSKGCFGLKLDRIGSMSGLGC

SEQ ID NO: 1061 - protein, 27 aa, Artificial Sequence
  Synthetic construct (additional CNP variant)
GANPRGLSKGCFGLKLDRIGSMSGLGC

SEQ ID NO: 1062 - protein, 27 aa, Artificial Sequence
  Synthetic construct (additional CNP variant)
GANSSGLSKGCFGLKLDRIGSMSGLGC

SEQ ID NO: 1063 - protein, 27 aa, Artificial Sequence
  Synthetic construct (additional CNP variant)
GANPRGLSRGCFGLKLDRIGSMSGLGC

SEQ ID NO: 1064 - protein, 27 aa, Artificial Sequence
  Synthetic construct (additional CNP variant)
GANRRGLSRGCFGLKLDRIGSMSGLGC

SEQ ID NO: 1065 - protein, 27 aa, Artificial Sequence
  Synthetic construct (additional CNP variant)
GANQQGLSRGCFGLKLDRIGSMSGLGC

SEQ ID NO: 1066 - protein, 27 aa, Artificial Sequence
  Synthetic construct (additional CNP variant)
GANSSGLSRGCFGLKLDRIGSMSGLGC

SEQ ID NO: 1067 - protein, 35 aa, Artificial Sequence
  Synthetic construct (additional CNP variant)
AAWARLLQEHPNAGLSKGCFGLKLDRIGSMSGLGC

SEQ ID NO: 1068 - protein, 36 aa, Artificial Sequence
  Synthetic construct (additional CNP variant)
AAWARLLQEHPNARGLSKGCFGLKLDRIGSMSGLGC

SEQ ID NO: 1069 - protein, 36 aa, Artificial Sequence
  Synthetic construct (additional CNP variant)
DLRVDTKSRAAWARGLSKGCFGLKLDRIGSMSGLGC

SEQ ID NO: 1070 - protein, 38 aa, Artificial Sequence; identical to SEQ ID NO: 1042
  Synthetic construct (additional CNP variant)

SEQ ID NO: 1071 - protein, 38 aa, Artificial Sequence; identical to SEQ ID NO: 1043
  Synthetic construct (additional CNP variant)

SEQ ID NO: 1072 - protein, 22 aa, Artificial Sequence
  Synthetic construct (additional CNP variant)
GLSRGCFGLKLDRIGSMSGLGC

SEQ ID NO: 1073 - protein, 24 aa, Artificial Sequence
  Synthetic construct (additional CNP variant)
ERGLSKGCFGLKLDRIGSMSGLGC

SEQ ID NO: 1074 - protein, 23 aa, Artificial Sequence
  Synthetic construct (additional CNP variant)
RGLSKGCFGLKLDRIGSMSGLGC

SEQ ID NO: 1075 - protein, 22 aa, Artificial Sequence
  Synthetic construct (additional CNP variant)
GLSRGCFGLRLDRIGSMSGLGC

SEQ ID NO: 1076 - protein, 22 aa, Artificial Sequence
  Synthetic construct (additional CNP variant)
  MISC_FEATURE (7)..(7): Xaa is D-Phe
GLSKGCXGLKLDRIGSMSGLGC

SEQ ID NO: 1077 - protein, 22 aa, Artificial Sequence
  Synthetic construct (additional CNP variant)
  MISC_FEATURE (7)..(7): Xaa is 3-amino-2-phenylpropionic acid
GLSKGCXGLKLDRIGSMSGLGC

SEQ ID NO: 1078 - protein, 22 aa, Artificial Sequence
  Synthetic construct (additional CNP variant)
RLSKGCFGLKLDRIGSMSGLGC

SEQ ID NO: 1079 - protein, 22 aa, Artificial Sequence
  Synthetic construct (additional CNP variant)
ELSKGCFGLKLDRIGSMSGLGC

SEQ ID NO: 1080 - protein, 22 aa, Artificial Sequence
  Synthetic construct (additional CNP variant)
GLSKRCFGLKLDRIGSMSGLGC

SEQ ID NO: 1081 - protein, 22 aa, Artificial Sequence
  Synthetic construct (additional CNP variant)
GLSKQCFGLKLDRIGSMSGLGC

SEQ ID NO: 1082 - protein, 22 aa, Artificial Sequence
  Synthetic construct (additional CNP variant)
GLSKSCFGLKLDRIGSMSGLGC

SEQ ID NO: 1083 - protein, 22 aa, Artificial Sequence
  Synthetic construct (additional CNP variant)
GLSKGCFGLKLDRISSMSGLGC

SEQ ID NO: 1084 - protein, 22 aa, Artificial Sequence
  Synthetic construct (additional CNP variant)
GLSKGCFGLKLDRINSMSGLGC

SEQ ID NO: 1085 - protein, 22 aa, Artificial Sequence
  Synthetic construct (additional CNP variant)
GLSKGCFGLKLDRIRSMSGLGC

SEQ ID NO: 1086 - protein, 22 aa, Artificial Sequence
  Synthetic construct (additional CNP variant)
  MISC_FEATURE (15)..(15): Xaa is Cit
GLSKGCFGLKLDRIXSMSGLGC

SEQ ID NO: 1087 - protein, 22 aa, Artificial Sequence
  Synthetic construct (additional CNP variant)
GLSKGCFGLKLDRIGSMSSLGC

SEQ ID NO: 1088 - protein, 22 aa, Artificial Sequence
  Synthetic construct (additional CNP variant)
GLSKGCFGLKLDRIGSMSRLGC

SEQ ID NO: 1089 - protein, 22 aa, Artificial Sequence
  Synthetic construct (additional CNP variant)
GLSKGCFGLKLDRIGSMSNLGC

SEQ ID NO: 1090 - protein, 22 aa, Artificial Sequence
  Synthetic construct (additional CNP variant)
GLSKGCFGLKLDRIGSMSGLSC

SEQ ID NO: 1091 - protein, 22 aa, Artificial Sequence
  Synthetic construct (additional CNP variant)
GLSKGCFGLKLDRIGSMSGLTC

SEQ ID NO: 1092 - protein, 22 aa, Artificial Sequence
  Synthetic construct (additional CNP variant)
GLSKGCFGLKLDRIGSMSGLRC

SEQ ID NO: 1093 - protein, 22 aa, Artificial Sequence
  Synthetic construct (additional CNP variant)
  MISC_FEATURE (6)..(7): [CH2NH] bond between residues 6 and 7
GLSKGCFGLKLDRIGSMSGLGC

SEQ ID NO: 1094 - protein, 22 aa, Artificial Sequence
  Synthetic construct (additional CNP variant)
  MISC_FEATURE (7)..(7): Xaa is N-Me-Phe
GLSKGCXGLKLDRIGSMSGLGC

SEQ ID NO: 1095 - protein, 22 aa, Artificial Sequence
  Synthetic construct (additional CNP variant)
  MISC_FEATURE (8)..(8): Xaa is t-Bu-Gly
GLSKGCFXLKLDRIGSMSGLGC

SEQ ID NO: 1096 - protein, 22 aa, Artificial Sequence
  Synthetic construct (additional CNP variant)
  MISC_FEATURE (7)..(7): Xaa is NHCH2CH(Ph)CO
GLSKGCXGLKLDRIGSMSGLGC

SEQ ID NO: 1097 - protein, 36 aa, Artificial Sequence
  Synthetic construct (additional CNP variant)
GQPREPQVYTLPPSGLSKGCFGLKLDRIGSMSGLGC

SEQ ID NO: 1098 - protein, 37 aa, Artificial Sequence
  Synthetic construct (additional CNP variant)
GERAFKAWAVARLSQGLSKGCFGLKLDRIGSMSGLGC

SEQ ID NO: 1099 - protein, 39 aa, Artificial Sequence
  Synthetic construct (additional CNP variant)
GQHKDDNPNLPRGANPRGLSKGCFGLKLDRIGSMSGLGC

SEQ ID NO: 1100 - protein, 37 aa, Artificial Sequence
  Synthetic construct (additional CNP variant)
GHHSHEQHPHGANQQGLSKGCFGLKLDRIGSMSGLGC

SEQ ID NO: 1101 - protein, 38 aa, Artificial Sequence
  Synthetic construct (additional CNP variant)
GAHHPHEHDTHGANQQGLSKGCFGLKLDRIGSMSGLGC

SEQ ID NO: 1102 - protein, 35 aa, Artificial Sequence
  Synthetic construct (additional CNP variant)
FGIPMDRIGRNPRGLSKGCFGLKLDRIGSMSGLGC

SEQ ID NO: 1103 - protein, 40 aa, Artificial Sequence [sequence omitted]

SEQ ID NO: 1104 - protein, 32 aa, Artificial Sequence
  Synthetic construct (additional CNP variant)
SPKMVQGSGCFGLKLDRIGSMSGLGCKVLRRH

SEQ ID NO: 1105 - protein, 37 aa, Artificial Sequence
  Synthetic construct (additional CNP variant)
GQPREPQVYTGANQQGLSRGCFGLKLDRIGSMSGLGC

SEQ ID NO: 1106 - protein, 36 aa, Artificial Sequence
  Synthetic construct (additional CNP variant)
GVPQVSTSTGANQQGLSRGCFGLKLDRIGSMSGLGC

SEQ ID NO: 1107 - protein, 37 aa, Artificial Sequence
  Synthetic construct (additional CNP variant)
GQPSSSSQSTGANQQGLSRGCFGLKLDRIGSMSGLGC

SEQ ID NO: 1108 - protein, 37 aa, Artificial Sequence
  Synthetic construct (additional CNP variant)
GSTGQWHSESGANQQGLSRGCFGLKLDRIGSMSGLGC

SEQ ID NO: 1109 - protein, 37 aa, Artificial Sequence
  Synthetic construct (additional CNP variant)
GQTHSSGTQSGANQQGLSRGCFGLKLDRIGSMSGLGC

SEQ ID NO: 1110 - protein, 37 aa, Artificial Sequence
  Synthetic construct (additional CNP variant)
GSSSSSSSSSGANQQGLSRGCFGLKLDRIGSMSGLGC

SEQ ID NO: 1111 - protein, 22 aa, Artificial Sequence
  Synthetic construct (additional CNP variant)
  MISC_FEATURE (6)..(7): [CH2NH] bond between residues 6 and 7
  MISC_FEATURE (9)..(9): Xaa is N-Me-Leu
  MISC_FEATURE (20)..(20): Xaa is N-Me-Leu
GLSKGCFGXKLDRIGSMSGXGC

SEQ ID NO: 1112 - protein, 22 aa, Artificial Sequence
  Synthetic construct (additional CNP variant)
  MISC_FEATURE (9)..(9): Xaa is N-Me-Leu
  MISC_FEATURE (20)..(20): Xaa is N-Me-Leu
GLSKGCFGXKLDRIGSMSGXGC

SEQ ID NO: 1113 - protein, 22 aa, Artificial Sequence
  Synthetic construct (additional CNP variant)
  MISC_FEATURE (9)..(9): Xaa is N-Me-Leu
  MISC_FEATURE (11)..(11): Xaa is N-Me-Leu
  MISC_FEATURE (20)..(20): Xaa is N-Me-Leu
GLSKGCFGXKXDRIGSMSGXGC

SEQ ID NO: 1114 - protein, 22 aa, Artificial Sequence
  Synthetic construct (additional CNP variant)
  MISC_FEATURE (9)..(9): Xaa is N-Me-Leu
  MISC_FEATURE (11)..(11): Xaa is N-Me-Leu
GLSKGCFGXKXDRIGSMSGLGC

SEQ ID NO: 1115 - protein, 22 aa, Artificial Sequence
  Synthetic construct (additional CNP variant)
GLSRGCYGLKLDRIGSMSGLGC

SEQ ID NO: 1116 - protein, 22 aa, Artificial Sequence
  Synthetic construct (additional CNP variant)
GLSRGCFVLKLDRIGSMSGLGC

SEQ ID NO: 1117 - protein, 22 aa, Artificial Sequence
  Synthetic construct (additional CNP variant)
GLSRGCFSLKLDRIGSMSGLGC

SEQ ID NO: 1118 - protein, 22 aa, Artificial Sequence
  Synthetic construct (additional CNP variant)
GLSRGCFTLKLDRIGSMSGLGC

SEQ ID NO: 1119 - protein, 22 aa, Artificial Sequence
  Synthetic construct (additional CNP variant)
GLSRGCFGTKLDRIGSMSGLGC

SEQ ID NO: 1120 - protein, 22 aa, Artificial Sequence
  Synthetic construct (additional CNP variant)
GLSRGCFGLKLDRIRSMSGLGC

SEQ ID NO: 1121 - protein, 22 aa, Artificial Sequence
  Synthetic construct (additional CNP variant)
  MISC_FEATURE (15)..(15): Xaa is Cit
GLSRGCFGLKLDRIXSMSGLGC

SEQ ID NO: 1122 - protein, 22 aa, Artificial Sequence
  Synthetic construct (additional CNP variant)
GLSRGCFGLKLDRIGSVSGLGC

SEQ ID NO: 1123 - protein, 22 aa, Artificial Sequence
  Synthetic construct (additional CNP variant)
GLSRGCFGLKLDRIGSMSGVGC

SEQ ID NO: 1124 - protein, 22 aa, Artificial Sequence
  Synthetic construct (additional CNP variant)
  MISC_FEATURE (20)..(20): Xaa is t-Bu-Ala
GLSRGCFGLKLDRIGSMSGXGC

SEQ ID NO: 1125 - protein, 22 aa, Artificial Sequence
  Synthetic construct (additional CNP variant)
ELSEGCFGLKLDRIGSMSGLGC

SEQ ID NO: 1126 - protein, 23 aa, Artificial Sequence
  Synthetic construct (additional CNP variant)
  MISC_FEATURE (1)..(1): Xaa is pentanoic acid
XELSEGCFGLKLDRIGSMSGLGC

SEQ ID NO: 1127 - protein, 23 aa, Artificial Sequence
  Synthetic construct (additional CNP variant)
  MISC_FEATURE (1)..(1): Xaa is heptanoic acid
XELSEGCFGLKLDRIGSMSGLGC

SEQ ID NO: 1128 - protein, 23 aa, Artificial Sequence
  Synthetic construct (additional CNP variant)
  MISC_FEATURE (1)..(1): Xaa is pentanoic acid
XELSKGCFGLKLDRIGSMSGLGC

SEQ ID NO: 1129 - protein, 23 aa, Artificial Sequence
  Synthetic construct (additional CNP variant)
  MISC_FEATURE (1)..(1): Xaa is heptanoic acid
XELSKGCFGLKLDRIGSMSGLGC

SEQ ID NO: 1130 - protein, 22 aa, Artificial Sequence
  Synthetic construct (additional CNP variant)
  MISC_FEATURE (10)..(10): Xaa is Cit
GLSKGCFGLXLDRIGSMSGLGC

SEQ ID NO: 1131 - protein, 22 aa, Artificial Sequence
  Synthetic construct (additional CNP variant)
GLSKGCFGLQLDRIGSMSGLGC

SEQ ID NO: 1132 - protein, 22 aa, Artificial Sequence
  Synthetic construct (additional CNP variant)
GLSKGCFGLRLDRIGSMSGLGC

SEQ ID NO: 1133 - protein, 22 aa, Artificial Sequence
  Synthetic construct (additional CNP variant)
GLSKGCFGLKLDRINSMSGLGC

SEQ ID NO: 1134 - protein, 22 aa, Artificial Sequence
  Synthetic construct (additional CNP variant)
GLSKGCFGLKLDRISSMSGLGC

SEQ ID NO: 1135 - protein, 22 aa, Artificial Sequence
  Synthetic construct (additional CNP variant)
  MISC_FEATURE (1)..(22): All D-amino acids
GLSKGCFGLKLDRIGSMSGLGC

SEQ ID NO: 1136 - protein, 22 aa, Artificial Sequence
  Synthetic construct (additional CNP variant)
  MISC_FEATURE (9)..(9): Xaa is N-Me-Leu
GLSKGCFGXKLDRIGSMSGLGC

SEQ ID NO: 1137 - protein, 22 aa, Artificial Sequence
  Synthetic construct (additional CNP variant)
  MISC_FEATURE (11)..(11): Xaa is N-Me-Leu
GLSKGCFGLKXDRIGSMSGLGC

SEQ ID NO: 1138 - protein, 22 aa, Artificial Sequence
  Synthetic construct (additional CNP variant)
  MISC_FEATURE (20)..(20): Xaa is N-Me-Leu
GLSKGCFGLKLDRIGSMSGXGC

SEQ ID NO: 1139 - protein, 22 aa, Artificial Sequence
  Synthetic construct (additional CNP variant)
  MISC_FEATURE (7)..(7): Xaa is 3,4-dichloro-Phe
GLSGGCXGLKLDRIGSMSGLGC

SEQ ID NO: 1140 - protein, 22 aa, Artificial Sequence
  Synthetic construct (additional CNP variant)
  MISC_FEATURE (7)..(7): Xaa is 3-Me-Phe
GLSGGCXGLKLDRIGSMSGLGC

SEQ ID NO: 1141 - protein, 22 aa, Artificial Sequence
  Synthetic construct (additional CNP variant)
GLSRSCFGLKLDRIGSMSGLGC

SEQ ID NO: 1142 - protein, 22 aa, Artificial Sequence
  Synthetic construct (additional CNP variant)
GLSRRCFGLKLDRIGSMSGLGC

SEQ ID NO: 1143 - protein, 22 aa, Artificial Sequence
  Synthetic construct (additional CNP variant)
GLSGGCFGLKLDRIGSMSGLGC

SEQ ID NO: 1144 - protein, 22 aa, Artificial Sequence
  Synthetic construct (additional CNP variant)
GLSGGCFGLSLDRIGSMSGLGC

SEQ ID NO: 1145 - protein, 22 aa, Artificial Sequence
  Synthetic construct (additional CNP variant)
GLSRGCFGLKLDRIGQMSGLGC

SEQ ID NO: 1146 - protein, 22 aa, Artificial Sequence
  Synthetic construct (additional CNP variant)
GLSRGCFGLKLDRIGSNSGLGC

SEQ ID NO: 1147 - protein, 22 aa, Artificial Sequence
  Synthetic construct (additional CNP variant)
GLSRGCFGLKLDRIGSMSSLGC

SEQ ID NO: 1148 - protein, 22 aa, Artificial Sequence
  Synthetic construct (additional CNP variant)
GLSRGCFGLKLDRIGSMSRLGC

SEQ ID NO: 1149 - protein, 22 aa, Artificial Sequence
  Synthetic construct (additional CNP variant)
GLSRGCFGLKLDRIGSMSGRGC

SEQ ID NO: 1150 - protein, 22 aa, Artificial Sequence
  Synthetic construct (additional CNP variant)
GLSRGCFGLKLDRIGSMSGLSC

SEQ ID NO: 1151 - protein, 22 aa, Artificial Sequence
  Synthetic construct (additional CNP variant)
GLSRGCFGLKLDRIGSMSGLTC

SEQ ID NO: 1152 - protein, 22 aa, Artificial Sequence
  Synthetic construct (additional CNP variant)
GLSRGCFGLKLDRIGSMSGLRC

SEQ ID NO: 1153 - protein, 22 aa, Artificial Sequence
  Synthetic construct (additional CNP variant)
  MISC_FEATURE (7)..(7): Xaa is D-Phe
GLSKGCXGLKLDRIGSMSGLGC

SEQ ID NO: 1154 - protein, 22 aa, Artificial Sequence
  Synthetic construct (additional CNP variant)
  MISC_FEATURE (7)..(7): Xaa is 3-Cl-Phe
GLSKGCXGLKLDRIGSMSGLGC

SEQ ID NO: 1155 - protein, 20 aa, Artificial Sequence
  Synthetic construct (additional CNP variant)
RSSCFGGRISRIGACFFFFF

SEQ ID NO: 1156 - protein, 17 aa, Artificial Sequence
  Synthetic Construct
CFGLKLDRIGSFSGLGC

SEQ ID NO: 1157 - protein, 17 aa, Artificial Sequence
  Synthetic Construct
CFGLKLDRIGSLSGLGC

SEQ ID NO: 1158 - protein, 17 aa, Artificial Sequence
  Synthetic Construct
CFGLKLDRIGSISGLGC

SEQ ID NO: 1159 - protein, 17 aa, Artificial Sequence
  Synthetic Construct
CFGLKLDRIGSTSGLGC

SEQ ID NO: 1160 - protein, 17 aa, Artificial Sequence
  Synthetic Construct
CFGLKLDRIGSVSGLGC

SEQ ID NO: 1161 - protein, 17 aa, Artificial Sequence
  Synthetic Construct
CFGLKLDRIGSASGLGC

SEQ ID NO: 1162 - protein, 17 aa, Artificial Sequence
  Synthetic Construct
CFGLKLDRIGSSSGLGC

SEQ ID NO: 1163 - protein, 17 aa, Artificial Sequence
  Synthetic Construct
CFGLKLDRIGSESGLGC

SEQ ID NO: 1164 - protein, 17 aa, Artificial Sequence
  Synthetic Construct
CFGLKLDRIGSRSGLGC

SEQ ID NO: 1165 - protein, 17 aa, Artificial Sequence
  Synthetic Construct
CFGLKLDRIGSYSGLGC

SEQ ID NO: 1166 - protein, 17 aa, Artificial Sequence
  Synthetic Construct
CFGLKLDRIGSCSGLGC

SEQ ID NO: 1167 - protein, 17 aa, Artificial Sequence
  Synthetic Construct
CFGLKLDRIGSPSGLGC

SEQ ID NO: 1168 - protein, 17 aa, Artificial Sequence
  Synthetic Construct
CFGLKLDRIGSDSGLGC

SEQ ID NO: 1169 - protein, 17 aa, Artificial Sequence
  Synthetic Construct
CFGLKLDRIGTSSGLGC

SEQ ID NO: 1170 - protein, 17 aa, Artificial Sequence
  Synthetic Construct
CFGLKLDRIGTFSGLGC

SEQ ID NO: 1171 - protein, 17 aa, Artificial Sequence
  Synthetic Construct
CFGVKLDRIGSMSGLGC

SEQ ID NO: 1172 - protein, 17 aa, Artificial Sequence
  Synthetic Construct
CFGVKLDRIGAFSGLGC

SEQ ID NO: 1173 - protein, 17 aa, Artificial Sequence
  Synthetic Construct
CFGHKLDRIGSTSGLGC

SEQ ID NO: 1174 - protein, 17 aa, Artificial Sequence
  Synthetic Construct
CFGLKLDRIGVVSGLGC

SEQ ID NO: 1175 - protein, 17 aa, Artificial Sequence
  Synthetic Construct
CFGMKMDRIGSISGLGC

SEQ ID NO: 1176 - protein, 17 aa, Artificial Sequence
  Synthetic Construct
CFGMKIDRIGSISGLGC

SEQ ID NO: 1177 - protein, 17 aa, Artificial Sequence
  Synthetic Construct
CFGLPLDHIGSVSGLGC

SEQ ID NO: 1178 - protein, 17 aa, Artificial Sequence
  Synthetic Construct
CFGLRLDRIGSMSGLGC

SEQ ID NO: 1179 - protein, 17 aa, Artificial Sequence
  Synthetic Construct
CFGLKLDRISSMSGLGC

SEQ ID NO: 1180 - protein, 17 aa, Artificial Sequence
  Synthetic Construct
CFGLKLDRINSMSGLGC

SEQ ID NO: 1181 - protein, 17 aa, Artificial Sequence
  Synthetic Construct
CFGLKLDRIRSMSGLGC

SEQ ID NO: 1182 - protein, 17 aa, Artificial Sequence
  Synthetic Construct
CFGLKLDRIGSMSSLGC

SEQ ID NO: 1183 - protein, 17 aa, Artificial Sequence
  Synthetic Construct
CFGLKLDRIGSMSNLGC

SEQ ID NO: 1184 - protein, 17 aa, Artificial Sequence
  Synthetic Construct
CFGLKLDRIGSMSGLSC

SEQ ID NO: 1185 - protein, 17 aa, Artificial Sequence
  Synthetic Construct
CFGLKLDRIGSMSGLTC

SEQ ID NO: 1186 - protein, 17 aa, Artificial Sequence
  Synthetic Construct
CFGLKLDRIGSMSGLRC

SEQ ID NO: 1187 - protein, 17 aa, Artificial Sequence
  Synthetic Construct
CYGLKLDRIGSMSGLGC

SEQ ID NO: 1188 - protein, 17 aa, Artificial Sequence
  Synthetic Construct
CFVLKLDRIGSMSGLGC

SEQ ID NO: 1189 - protein, 17 aa, Artificial Sequence
  Synthetic Construct
CFSLKLDRIGSMSGLGC

SEQ ID NO: 1190 - protein, 17 aa, Artificial Sequence
  Synthetic Construct
CFTLKLDRIGSMSGLGC

SEQ ID NO: 1191 - protein, 17 aa, Artificial Sequence
  Synthetic Construct
CFGLKLDRIRSMSGLGC

SEQ ID NO: 1192 - protein, 17 aa, Artificial Sequence
  Synthetic Construct
CFGLKLDRIGSMSGVGC

SEQ ID NO: 1193 - protein, 17 aa, Artificial Sequence
  Synthetic Construct
CFGLQLDRIGSMSGLGC

SEQ ID NO: 1194 - protein, 17 aa, Artificial Sequence
  Synthetic Construct
CFGLRLDRIGSMSGLGC

SEQ ID NO: 1195 - protein, 17 aa, Artificial Sequence
  Synthetic Construct
CFGLKLDRINSMSGLGC

SEQ ID NO: 1196 - protein, 17 aa, Artificial Sequence
  Synthetic Construct
CFGLKLDRISSMSGLGC

SEQ ID NO: 1197 - protein, 17 aa, Artificial Sequence
  Synthetic Construct
CFGLSLDRIGSMSGLGC

SEQ ID NO: 1198 - protein, 17 aa, Artificial Sequence
  Synthetic Construct
CFGLKLDRIGQMSGLGC

SEQ ID NO: 1199 - protein, 17 aa, Artificial Sequence
  Synthetic Construct
CFGLKLDRIGSMSSLGC

SEQ ID NO: 1200 - protein, 17 aa, Artificial Sequence
  Synthetic Construct
CFGLKLDRIGSMSRLGC

SEQ ID NO: 1201 - protein, 17 aa, Artificial Sequence
  Synthetic Construct
CFGLKLDRIGSMSGRGC

SEQ ID NO: 1202 - protein, 17 aa, Artificial Sequence
  Synthetic Construct
CFGLKLDRIGSMSGLSC

SEQ ID NO: 1203 - protein, 17 aa, Artificial Sequence
  Synthetic Construct
CFGLKLDRIGSMSGLTC

SEQ ID NO: 1204 - protein, 17 aa, Artificial Sequence
  Synthetic Construct
CFGLKLDRIGSMSGLRC

SEQ ID NO: 1205 - protein, 17 aa, Artificial Sequence
  Synthetic Construct
CFGGRISRIGACFFFFF

SEQ ID NO: 1206 - protein, 9 aa, Artificial Sequence
  Synthetic Construct
GGGGSGGGG

What is claimed is:

1. An isolated polypeptide comprising the structure X-Fc-Y-NP-Z or the structure X-NP-Y-Fc-Z, wherein NP is a natriuretic peptide that is an agonist of natriuretic peptide receptor B (NPR-B), wherein said NP comprises the structure: [N-terminal extension]-[short segment]-[ring domain]-[C-terminal extension], wherein each of said N-terminal extension, short segment, and C-terminal extension is, independently, absent or is an amino acid sequence of at least one amino acid, and wherein said NP comprises amino acids 6-22 of SEQ ID NO: 126, wherein the amino-acid at position 17 is not Met, and wherein:
   (i) each of X and Z is, independently, absent or is an amino acid sequence of at least one amino acid; and
   (ii) the amino acid sequence of Y comprises [(Gly)$_4$(Ser)]$_n$(Gly)$_p$ or (Gly)$_p$[(Ser)(Gly)$_4$]$_n$, wherein n is between 1 and 10 and p is between 0 and 4, or wherein the amino acid sequence of Y comprises the amino acid sequence of any one of SEQ ID NOs: 304-313, 322-333, or 337-389.

2. The isolated polypeptide of claim 1, wherein said polypeptide comprises the structure X-Fc-Y-NP-Z.

3. The isolated polypeptide of claim 1, wherein said NP comprises the sequence of any one of SEQ ID NOs: 1156-1159 and 1163-1168.

4. The isolated polypeptide of claim 3, wherein said NP comprises the sequence of SEQ ID NO: 1156 or 1157.

5. The isolated polypeptide of claim 4, wherein said NP comprises the sequence of SEQ ID NO: 1157.

6. The isolated polypeptide of claim 1, wherein said ring domain comprises the amino acid sequence of SEQ ID NO: 6, amino acids 11-27 of SEQ ID NO: 30, or SEQ ID NO: 95.

7. The isolated polypeptide of claim 1, wherein the amino acid sequence of said short segment consists of amino acids 1-5 of SEQ ID NO: 4.

8. The isolated polypeptide of claim 1, wherein the amino acid sequence of said short segment consists of amino acids 1-5, 2-5, 3-5, 4-5, or 5 of SEQ ID NO: 4, amino acids 1-10 of SEQ ID NO: 17, amino acids 1-5 of SEQ ID NO: 19, amino acids 1-3 of SEQ ID NO: 20, amino acids 1-5 of SEQ ID NO: 21, or amino acids 1-6 of SEQ ID NO: 29.

9. The isolated polypeptide of claim 1, wherein the amino acid sequence of said N-terminal extension comprises KGANKK (SEQ ID NO: 314) or KGANQK (SEQ ID NO: 315).

10. The isolated polypeptide of claim 1, wherein said C-terminal extension comprises the amino acid sequence of SEQ ID NO: 118.

11. The isolated polypeptide of claim 10, wherein said C-terminal extension comprises the amino acid sequence of SEQ ID NO: 117 or comprises amino acids 23-37 selected from any one of SEQ ID NOs: 101-116.

12. The isolated polypeptide of claim 1, wherein said NP is selective for NPR-B over NPR-A, wherein the EC$_{50(NPR-A)}$/EC$_{50(NPR-B)}$ ratio for said NP, as determined in an in vivo pharmacokinetic assay, is at least 30.

13. The isolated polypeptide of claim 1, wherein said Fc comprises a C$_{H2}$ domain, a C$_{H3}$ domain, and a hinge region.

14. The isolated polypeptide of claim 13, wherein said Fc is a constant domain of an immunoglobulin selected from the group consisting of IgG-1, IgG-2, IgG-3, IgG-3 and IgG-4.

15. The isolated polypeptide of claim 13, wherein said Fc comprises the amino acid sequence of SEQ ID NO: 401.

16. The isolated polypeptide of claim 14, wherein said immunoglobulin is IgG-1.

17. The isolated polypeptide of claim 13, wherein the amino acid sequence of said Fc comprises an amino acid sequence having at least 85% sequence identity to SEQ ID NO: 401.

18. The isolated polypeptide of claim 13, wherein the amino acid sequence of said Fc consists of SEQ ID NO: 401.

19. The isolated polypeptide of claim 1, wherein the amino acid sequence of Y comprises the sequence of SEQ ID NO: 1206.

20. The isolated polypeptide of claim 1, wherein X, Y, or Z comprises a bone-targeting moiety.

21. The isolated polypeptide of claim 20, wherein said bone-targeting moiety comprises six consecutive acidic residues.

22. The isolated polypeptide of claim 21, wherein said bone-targeting moiety comprises ten consecutive acidic residues.

23. The isolated polypeptide of claim 21, wherein said acidic residues are aspartic acid or glutamic acid.

24. The isolated polypeptide of claim 23, wherein said bone-targeting moiety comprises $E_6$, $E_{10}$, $D_6$, or $D_{10}$.

25. The isolated polypeptide of claim 1, wherein X, Y, or Z comprises a cathepsin cleavage sequence.

26. The isolated polypeptide of claim 25, wherein said cathepsin cleavage sequence comprises a cathepsin K cleavage sequence.

27. The isolated polypeptide of claim 25, wherein said cathepsin cleavage sequence is HGPQG (SEQ ID NO: 374) or HKLRG (SEQ ID NO: 375).

28. The isolated polypeptide of claim 1, wherein said polypeptide comprises the amino acid sequence of any one of SEQ ID NOs: 501-608.

29. The isolated polypeptide of claim 28, wherein said polypeptide comprises the amino acid sequence of any one of SEQ ID NO: 572, SEQ ID NO: 502, SEQ ID NO: 504, SEQ ID NO: 506, SEQ ID NO: 512, SEQ ID NO: 514, SEQ ID NO: 516, SEQ ID NO: 560, SEQ ID NO: 562, SEQ ID NO: 564, SEQ ID NO: 574, SEQ ID NO: 576, SEQ ID NO: 584, SEQ ID NO: 586, SEQ ID NO: 588, SEQ ID NO: 596, SEQ ID NO: 598, SEQ ID NO: 600, or SEQ ID NO: 608.

30. The isolated polypeptide of claim 29, wherein said polypeptide comprises a bone-targeting moiety.

31. The isolated polypeptide of claim 30, wherein said bone-targeting moiety comprises $E_6$, $E_{10}$, $D_6$, or $D_{10}$.

32. The isolated polypeptide of claim 1, wherein the amino acid sequence of said polypeptide comprises the amino acid sequence of SEQ ID NO: 512.

33. The isolated polypeptide of claim 32, wherein the amino acid sequence of said polypeptide consists of the amino acid sequence of SEQ ID NO: 512.

34. The isolated polypeptide of claim 1, wherein the amino acid sequence of said polypeptide comprises the amino acid sequence of SEQ ID NO: 554.

35. The isolated polypeptide of claim 34, wherein the amino acid sequence of said polypeptide consists of the amino acid sequence of SEQ ID NO: 554.

36. The isolated polypeptide of claim 1, wherein the amino acid sequence of said polypeptide comprises the amino acid sequence of SEQ ID NO: 572.

37. The isolated polypeptide of claim 36, wherein the amino acid sequence of said polypeptide consists of the amino acid sequence of SEQ ID NO: 572.

38. The isolated polypeptide of claim 1, wherein said polypeptide is glycosylated.

39. The isolated polypeptide of claim 1, wherein said polypeptide is pegylated.

40. The isolated polypeptide of claim 1, comprising a bone-targeting moiety.

41. The isolated polypeptide of claim 40, wherein said bone-targeting moiety comprises $E_6$, $E_{10}$, $D_6$, or $D_{10}$.

42. A pharmaceutical composition comprising:
    (a) the isolated polypeptide of claim 1; and
    (b) a pharmaceutically acceptable excipient.

43. A kit comprising:
    (a) the pharmaceutical composition of claim 42; and
    (b) instructions for administering said pharmaceutical composition to a subject to treat a disorder associated with overactivation of FGFR3, a bone or cartilage disorder, or a hypertensive disorder.

44. A kit comprising:
    (a) the pharmaceutical composition of claim 42; and
    (b) instructions for administering said pharmaceutical composition to a subject to elongate bone.

45. A pharmaceutical composition comprising:
    (a) the isolated polypeptide of claim 36, wherein said isolated polypeptide consist of SEQ ID NO: 572; and
    (b) a pharmaceutically acceptable excipient.

* * * * *